United States Patent
Sampson et al.

(10) Patent No.: US 8,318,900 B2
(45) Date of Patent: Nov. 27, 2012

(54) PESTICIDAL PROTEINS AND METHODS FOR THEIR USE

(75) Inventors: Kimberly S. Sampson, Durham, NC (US); Daniel John Tomso, Bahama, NC (US); Razvan Valeriu Dumitru, Chapel Hill, NC (US)

(73) Assignee: Athenix Corp., Research Triangle Park, NC (US)

( * ) Notice: Subject to any disclaimer, the term of this patent is extended or adjusted under 35 U.S.C. 154(b) by 384 days.

(21) Appl. No.: 12/713,239

(22) Filed: Feb. 26, 2010

(65) Prior Publication Data

US 2010/0298207 A1 Nov. 25, 2010

Related U.S. Application Data

(60) Provisional application No. 61/156,301, filed on Feb. 27, 2009.

(51) Int. Cl.
*C07K 14/325* (2006.01)
(52) U.S. Cl. .................................................... 530/350
(58) Field of Classification Search ........................ None
See application file for complete search history.

(56) References Cited

U.S. PATENT DOCUMENTS

2006/0212965 A1* 9/2006 Carozzi et al. ................ 800/279

* cited by examiner

*Primary Examiner* — Christina Bradley
(74) *Attorney, Agent, or Firm* — Baker, Donelson, Bearman, Caldwell & Berkowitz, PC

(57) ABSTRACT

Compositions and methods for conferring pesticidal activity to bacteria, plants, plant cells, tissues and seeds are provided. Compositions comprising a coding sequence for a toxin polypeptide are provided. The coding sequences can be used in DNA constructs or expression cassettes for transformation and expression in plants and bacteria. Compositions also comprise transformed bacteria, plants, plant cells, tissues, and seeds. In particular, isolated toxin nucleic acid molecules are provided. Additionally, amino acid sequences corresponding to the polynucleotides are encompassed, and antibodies specifically binding to those amino acid sequences. In particular, the present invention provides for isolated nucleic acid molecules comprising nucleotide sequences encoding the amino acid sequence shown in SEQ ID NO:50-96, or the nucleotide sequence set forth in SEQ ID NO:1-47, as well as variants and fragments thereof.

9 Claims, No Drawings

PESTICIDAL PROTEINS AND METHODS FOR THEIR USE

CROSS REFERENCE TO RELATED APPLICATION

This application claims the benefit of U.S. Provisional Application Ser. No. 61/156,301, filed Feb. 27, 2009, the contents of which are herein incorporated by reference in their entirety.

REFERENCE TO SEQUENCE LISTING SUBMITTED ELECTRONICALLY

The official copy of the sequence listing is submitted electronically via EFS-Web as an ASCII formatted sequence listing with a file named "385315_SequenceListing.txt", created on Feb. 23, 2010, and having a size of 698 kilobytes and is filed concurrently with the specification. The sequence listing contained in this ASCII formatted document is part of the specification and is herein incorporated by reference in its entirety.

FIELD OF THE INVENTION

This invention relates to the field of molecular biology. Provided are novel genes that encode pesticidal proteins. These proteins and the nucleic acid sequences that encode them are useful in preparing pesticidal formulations and in the production of transgenic pest-resistant plants.

BACKGROUND OF THE INVENTION

*Bacillus thuringiensis* is a Gram-positive spore forming soil bacterium characterized by its ability to produce crystalline inclusions that are specifically toxic to certain orders and species of insects, but are harmless to plants and other non-targeted organisms. For this reason, compositions including *Bacillus thuringiensis* strains or their insecticidal proteins can be used as environmentally-acceptable insecticides to control agricultural insect pests or insect vectors for a variety of human or animal diseases.

Crystal (Cry) proteins (delta-endotoxins) from *Bacillus thuringiensis* have potent insecticidal activity against predominantly Lepidopteran, Dipteran, and Coleopteran larvae. These proteins also have shown activity against Hymenoptera, Homoptera, Phthiraptera, Mallophaga, and Acari pest orders, as well as other invertebrate orders such as Nemathelminthes, Platyhelminthes, and Sarcomastigorphora (Feitelson (1993) The *Bacillus Thuringiensis* family tree. In Advanced Engineered Pesticides, Marcel Dekker, Inc., New York, N.Y.) These proteins were originally classified as CryI to CryV based primarily on their insecticidal activity. The major classes were Lepidoptera-specific (I), Lepidoptera- and Diptera-specific (II), Coleoptera-specific (III), Diptera-specific (IV), and nematode-specific (V) and (VI). The proteins were further classified into subfamilies; more highly related proteins within each family were assigned divisional letters such as Cry1A, Cry1B, Cry1C, etc. Even more closely related proteins within each division were given names such as Cry1C1, Cry1C2, etc.

A new nomenclature was recently described for the Cry genes based upon amino acid sequence homology rather than insect target specificity (Crickmore et al. (1998) *Microbiol. Mol. Biol. Rev.* 62:807-813). In the new classification, each toxin is assigned a unique name incorporating a primary rank (an Arabic number), a secondary rank (an uppercase letter), a tertiary rank (a lowercase letter), and a quaternary rank (another Arabic number). In the new classification, Roman numerals have been exchanged for Arabic numerals in the primary rank. Proteins with less than 45% sequence identity have different primary ranks, and the criteria for secondary and tertiary ranks are 78% and 95%, respectively.

The crystal protein does not exhibit insecticidal activity until it has been ingested and solubilized in the insect midgut. The ingested protoxin is hydrolyzed by proteases in the insect digestive tract to an active toxic molecule. (Höfte and Whiteley (1989) *Microbiol. Rev.* 53:242-255). This toxin binds to apical brush border receptors in the midgut of the target larvae and inserts into the apical membrane creating ion channels or pores, resulting in larval death.

Delta-endotoxins generally have five conserved sequence domains, and three conserved structural domains (see, for example, de Maagd et al. (2001) *Trends Genetics* 17:193-199). The first conserved structural domain consists of seven alpha helices and is involved in membrane insertion and pore formation. Domain II consists of three beta-sheets arranged in a Greek key configuration, and domain III consists of two antiparallel beta-sheets in "jelly-roll" formation (de Maagd et al., 2001, supra). Domains II and III are involved in receptor recognition and binding, and are therefore considered determinants of toxin specificity.

Aside from delta-endotoxins, there are several other known classes of pesticidal protein toxins. The VIP1/VIP2 toxins (see, for example, U.S. Pat. No. 5,770,696) are binary pesticidal toxins that exhibit strong activity on insects by a mechanism believed to involve receptor-mediated endocytosis followed by cellular toxification, similar to the mode of action of other binary ("A/B") toxins. A/B toxins such as VIP, C2, CDT, CST, or the *B. anthracis* edema and lethal toxins initially interact with target cells via a specific, receptor-mediated binding of "B" components as monomers. These monomers then form homoheptamers. The "B" heptamer-receptor complex then acts as a docking platform that subsequently binds and allows the translocation of an enzymatic "A" component(s) into the cytosol via receptor-mediated endocytosis. Once inside the cell's cytosol, "A" components inhibit normal cell function by, for example, ADP-ribosylation of G-actin, or increasing intracellular levels of cyclic AMP (cAMP). See Barth et al. (2004) *Microbiol Mol Biol Rev* 68:373-402.

The intensive use of *B. thuringiensis*-based insecticides has already given rise to resistance in field populations of the diamondback moth, *Plutella xylostella* (Ferré and Van Rie (2002) Annu Rev. Entomol. 47:501-533). The most common mechanism of resistance is the reduction of binding of the toxin to its specific midgut receptor(s). This may also confer cross-resistance to other toxins that share the same receptor (Ferré and Van Rie (2002)).

SUMMARY OF INVENTION

Compositions and methods for conferring pest resistance to bacteria, plants, plant cells, tissues and seeds are provided. Compositions include nucleic acid molecules encoding sequences for toxin polypeptides, vectors comprising those nucleic acid molecules, and host cells comprising the vectors. Compositions also include the polypeptide sequences of the toxin, and antibodies to those polypeptides. The nucleotide sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues, and seeds.

In particular, isolated nucleic acid molecules corresponding to toxin nucleic acid sequences are provided. Additionally, amino acid sequences corresponding to the polynucleotides are encompassed. In particular, the present invention provides for an isolated nucleic acid molecule comprising a nucleotide sequence encoding the amino acid sequence shown in any of SEQ ID NO:50-96, or a nucleotide sequence set forth in any of SEQ ID NO:1-47, as well as variants and fragments thereof. Nucleotide sequences that are complementary to a nucleotide sequence of the invention, or that hybridize to a sequence of the invention are also encompassed.

The compositions and methods of the invention are useful for the production of organisms with pesticide resistance, specifically bacteria and plants. These organisms and compositions derived from them are desirable for agricultural purposes. The compositions of the invention are also useful for generating altered or improved toxin proteins that have pesticidal activity, or for detecting the presence of toxin proteins or nucleic acids in products or organisms.

The following embodiments are encompassed by the present invention:

1. A recombinant nucleic acid molecule comprising a nucleotide sequence encoding an amino acid sequence having pesticidal activity, wherein said nucleotide sequence is selected from the group consisting of:
   a) the nucleotide sequence set forth in any of SEQ ID NO:1-47;
   b) a nucleotide sequence that encodes a polypeptide comprising the amino acid sequence of any of SEQ ID NO:50-96; and
   c) a nucleotide sequence that encodes a polypeptide comprising an amino acid sequence having at least 95% sequence identity to the amino acid sequence of any of SEQ ID NO:50-96.

2. The recombinant nucleic acid molecule of embodiment 1, wherein said nucleotide sequence is a synthetic sequence that has been designed for expression in a plant.

3. The recombinant nucleic acid molecule of embodiment 2, wherein said sequence is set forth in any of SEQ ID NO:97-203.

4. The recombinant nucleic acid molecule of claim 1, wherein said nucleotide sequence is operably linked to a promoter capable of directing expression of said nucleotide sequence in a plant cell.

5. A vector comprising the nucleic acid molecule of embodiment 1.

6. The vector of embodiment 5, further comprising a nucleic acid molecule encoding a heterologous polypeptide.

7. A host cell that contains the vector of embodiment 5.

8. The host cell of embodiment 7 that is a bacterial host cell.

9. The host cell of embodiment 7 that is a plant cell.

10. A transgenic plant comprising the host cell of embodiment 9.

11. The transgenic plant of embodiment 10, wherein said plant is selected from the group consisting of maize, sorghum, wheat, cabbage, sunflower, tomato, crucifers, peppers, potato, cotton, rice, soybean, sugarbeet, sugarcane, tobacco, barley, and oilseed rape.

12. A transgenic seed comprising the nucleic acid molecule of embodiment 1.

13. A recombinant polypeptide with pesticidal activity, selected from the group consisting of:
   a) a polypeptide comprising the amino acid sequence of any of SEQ ID NO:50-96;
   b) a polypeptide comprising an amino acid sequence having at least 95% sequence identity to the amino acid sequence of any of SEQ ID NO:50-96; and
   c) a polypeptide that is encoded by any of SEQ ID NO:1-47.

14. The polypeptide of embodiment 13 further comprising heterologous amino acid sequences.

15. A composition comprising the recombinant polypeptide of embodiment 13.

16. The composition of embodiment 15, wherein said composition is selected from the group consisting of a powder, dust, pellet, granule, spray, emulsion, colloid, and solution.

17. The composition of embodiment 15, wherein said composition is prepared by desiccation, lyophilization, homogenization, extraction, filtration, centrifugation, sedimentation, or concentration of a culture of bacterial cells.

18. The composition of embodiment 15, comprising from about 1% to about 99% by weight of said polypeptide.

19. A method for controlling a lepidopteran, coleopteran, heteropteran, nematode, or dipteran pest population comprising contacting said population with a pesticidally-effective amount of the polypeptide of embodiment 13.

20. A method for killing a lepidopteran, coleopteran, heteropteran, nematode, or dipteran pest, comprising contacting said pest with, or feeding to said pest, a pesticidally-effective amount of the polypeptide of embodiment 13.

21. A method for producing a polypeptide with pesticidal activity, comprising culturing the host cell of embodiment 7 under conditions in which the nucleic acid molecule encoding the polypeptide is expressed.

22. A plant having stably incorporated into its genome a DNA construct comprising a nucleotide sequence that encodes a protein having pesticidal activity, wherein said nucleotide sequence is selected from the group consisting of:
   a) the nucleotide sequence set forth in any of SEQ ID NO:1-47;
   b) a nucleotide sequence that encodes a polypeptide comprising the amino acid sequence of any of SEQ ID NO:50-96; and
   c) a nucleotide sequence that encodes a polypeptide comprising an amino acid sequence having at least 95% sequence identity to the amino acid sequence of any of SEQ ID NO:50-96;
wherein said nucleotide sequence is operably linked to a promoter that drives expression of a coding sequence in a plant cell.

23. The plant of embodiment 22, wherein said plant is a plant cell.

24. A method for protecting a plant from a pest, comprising expressing in a plant or cell thereof a nucleotide sequence that encodes a pesticidal polypeptide, wherein said nucleotide sequence is selected from the group consisting of:
   a) the nucleotide sequence set forth in any of SEQ ID NO:1-47;
   b) a nucleotide sequence that encodes a polypeptide comprising the amino acid sequence of any of SEQ ID NO:50-96; and
   c) a nucleotide sequence that encodes a polypeptide comprising an amino acid sequence having at least 95% sequence identity to the amino acid sequence of any of SEQ ID NO:50-96.

25. The method of embodiment 24, wherein said plant produces a pesticidal polypeptide having pesticidal activity against a lepidopteran, coleopteran, heteropteran, nematode, or dipteran pest.

26. A method for increasing yield in a plant comprising growing in a field a plant of or a seed thereof having stably incorporated into its genome a DNA construct comprising a nucleotide sequence that encodes a protein having pesticidal activity, wherein said nucleotide sequence is selected from the group consisting of:
  a) the nucleotide sequence set forth in any of SEQ ID NO:1-47;
  b) a nucleotide sequence that encodes a polypeptide comprising the amino acid sequence of any of SEQ ID NO:50-96; and
  c) a nucleotide sequence that encodes a polypeptide comprising an amino acid sequence having at least 95% sequence identity to the amino acid sequence of any of SEQ ID NO:50-96;
wherein said field is infested with a pest against which said polypeptide has pesticidal activity.

DETAILED DESCRIPTION

The present invention is drawn to compositions and methods for regulating pest resistance in organisms, particularly plants or plant cells. The methods involve transforming organisms with a nucleotide sequence encoding a toxin protein of the invention. In particular, the nucleotide sequences of the invention are useful for preparing plants and microorganisms that possess pesticidal activity. Thus, transformed bacteria, plants, plant cells, plant tissues and seeds are provided. Compositions are toxin nucleic acids and proteins of *Bacillus thuringiensis*. The sequences find use in the construction of expression vectors for subsequent transformation into organisms of interest, as probes for the isolation of other toxin genes, and for the generation of altered pesticidal proteins by methods known in the art, such as domain swapping or DNA shuffling. The proteins find use in controlling or killing lepidopteran, coleopteran, and nematode pest populations, and for producing compositions with pesticidal activity.

By "toxin" is intended a sequence disclosed herein that has toxic activity against one or more pests, including, but not limited to, members of the Lepidoptera, Diptera, and Coleoptera orders or members of the Nematoda phylum, or a protein that has homology to such a protein. In some cases, toxin proteins have been isolated from *Bacillus* sp. In another embodiment, the toxins have been isolated from other organisms, including *Clostridium bifermentans* and *Paenibacillus popilliae*. Toxin proteins include amino acid sequences deduced from the full-length nucleotide sequences disclosed herein, and amino acid sequences that are shorter than the full-length sequences, either due to the use of an alternate downstream start site, or due to processing that produces a shorter protein having pesticidal activity. Processing may occur in the organism the protein is expressed in, or in the pest after ingestion of the protein.

In various embodiments, the sequences disclosed herein have homology to delta-endotoxin proteins. Delta-endotoxins include proteins identified as cry1 through cry53, cyt1 and cyt2, and Cyt-like toxin. There are currently over 250 known species of delta-endotoxins with a wide range of specificities and toxicities. For an expansive list see Crickmore et al. (1998), *Microbiol. Mol. Biol. Rev.* 62:807-813, and for regular updates see Crickmore et al. (2003) "*Bacillus thuringiensis* toxin nomenclature," at www.biols.susx.ac.uk/Home/Neil_Crickmore/Bt/index. In some embodiments, the delta-endotoxin sequences disclosed herein include the nucleotide sequences set forth in any of SEQ ID NO:1-47 or 97-203, the amino acid sequences set forth in any of SEQ ID NO:50-96, as well as variants and fragments thereof.

cry8 Homologues

In one embodiment, the sequences disclosed herein have homology to the cry8 family of delta-endotoxins. The cry8 family of delta-endotoxins has been shown to be toxic to coleopteran insects. For example, coleopteran-active Cry8 mutants are described in U.S. Pat. No. 7,105,332 (herein incorporated by reference in its entirety). Also presented in the '332 patent is a cry8 homology model built from the solved structure of the Cry3A gene (Li et al. (1991) Nature 353:815 821) which provides insight into the relationship between structure and function of the endotoxin In some embodiments, the cry8 homologues encompassed herein include the nucleotide sequences include the nucleotide sequences set forth in SEQ ID NO:1, 2, and 3, as well as the amino acid sequences set forth in SEQ ID NO:50, 51, and 52. Biologically-active variants and fragments of these sequences are also encompassed.

cry7-like Sequences

In one embodiment, the sequences disclosed herein are cry7-like delta-endotoxins. In various embodiments, the cry7-like sequences of the invention include the nucleotide sequence set forth in SEQ ID NO:4, the amino acid sequence set forth in SEQ ID NO:53, as well as biologically-active variants and fragments thereof.

cry1I Homolog

In another embodiment, the sequences disclosed herein have homology to the cry1I family of delta-endotoxins. In some embodiments, the cry1I homologues include the nucleotide sequence set forth in SEQ ID NO:5, the amino acid sequence set forth in SEQ ID NO:54, and biologically-active variants and fragments thereof.

The cry1I genes (formerly cryV genes), encode proteins of around 70 to 81 kDa that do not accumulate in the crystal (Choi et al. (2000) Curr. Microbiol. 41:65-69; Gleave et al. (1993) Appl. Environ. Microbiol. 59:1683-1687; Kostichka et al. (1996) J. Bacteriol. 178:2141-2144; U.S. Pat. Nos. 6,232,439; 5,723,758; Selvapandiyan et al. (2001) Appl. Environ. Microbiol. 67:5855-5858; Shin et al. (1995) Appl. Environ. Microbiol. 61:2402-2407; Song et al. (2003) Appl. Environ. Microbiol. 69:5207-5211; Tailor et al. (1992) Mol. Microbiol. 6:1211-1217; and Tounsi et al. (2003) J. Appl. Microbiol. 95:23-28); these have been classified as Cry1I proteins due to their similarity with those in the Cry1 group (Crickmore et al. (1998) Microbiol. Mol. Biol. Rev. 62:807-813). The effectiveness of Cry1I in protecting transformed plants from insect attack has been demonstrated (Lagnaoui et al. (2001) CIP Program Rep. 1999-2000:117-121; Liu et al. (2004) Acta Biochim. Biophys. Sin. 36:309-313; and Selvapandiyan et al. (1998) Mol. Breed. 4:473-478). cry1I genes are usually either silent or expressed in the vegetative phase and secreted into the growth suspension (Kostichka et al. (1996) J. Bacteriol. 178:2141-2144; Selvapandiyan et al. (2001) Appl. Environ. Microbiol. 67:5855-5858; Song et al. (2003) Appl. Environ. Microbiol. 69:5207-5211; and Tounsi et al. (2003) J. Appl. Microbiol. 95:23-28). Cry1I proteins have a broader host range than most other Cry1 proteins, and the hosts include important species of lepidopteran and coleopteran pests (Tailor et al. (1992) Mol. Microbiol. 6:1211-1217).

cry9 Homologues

In another embodiment, the sequences disclosed herein have homology to the cry9 family of delta-endotoxins. In some embodiments, the cry9 homologues include the nucleotide sequence set forth in SEQ ID NO:6, the amino acid sequence set forth in SEQ ID NO:55, and biologically-active variants and fragments thereof.

cry4 Homologues

In another embodiment, the sequences disclosed herein have homology to the cry4 family of delta-endotoxins. In various embodiments, the cry4 homologues encompassed herein include the nucleotide sequences set forth in SEQ ID NO:7, 8, 9, 10, 11, and 12, the amino acid sequences set forth in SEQ ID NO:56, 57, 58, 59, 60, and 61, and biologically-active variants and fragments thereof.

The cry4 family of delta-endotoxins has been shown to have activity against dipteran pests. Angsuthanasombat et al. ((2004) *Journal of Biochemistry and Molecular Biology* 37(3):304-313, which is herein incorporated by reference in its entirety, particularly with respect to the structural analysis of cry4) describe the 3-D structure of cry4 and correlate the structure with dipteran activity.

cryC35/53-like Sequences

In another embodiment, the sequences disclosed herein are cryC35/cryC53-like sequences. In some embodiments, the cryC35/cryC53-like sequences include the nucleotide sequences set forth in SEQ ID NO:13, 14, 15, or 16, the amino acid sequences set forth in SEQ ID NO:62, 63, 64, and 65, and biologically-active variants and fragments thereof.

cry21/cry12-like Sequences

In another embodiment, the sequences disclosed herein are cry21/cry12-like sequences. The cry12/21 family has been shown to have activity against nematode pests (Wei (2003) Proc. Natl. Acad. Sci. USA 100(5):2760-2765 and European Patent No. 0462721A2, each of which is herein incorporated by reference). In various embodiments, the cry21/cry12-like sequences encompassed herein include the nucleotide sequences set forth in SEQ ID NO:17, 18, 19, and 20, the amino acid sequences set forth in SEQ ID NO:66, 67, 68, and 69, and biologically-active variants and fragments thereof.

VIP-Like or Binary-Like Sequences

In another embodiment, the sequences disclosed herein are VIP-like or binary-like proteins. Vegetative insecticidal proteins (VIPs) are insecticidal proteins produced during vegetative growth of the bacteria and are thus classified as exotoxins. The VIP gene shows insecticidal activity against a variety of lepidopterans.

The VIP1/VIP2 toxins (see, for example, U.S. Pat. No. 5,770,696, herein incorporated by reference in its entirety) are binary pesticidal toxins that exhibit strong activity on insects by a mechanism believed to involve receptor-mediated endocytosis followed by cellular toxification, similar to the mode of action of other binary ("A/B") toxins. A/B toxins such as VIP, C2, CDT, CST, or the *B. anthracis* edema and lethal toxins initially interact with target cells via a specific, receptor-mediated binding of "B" components as monomers. These monomers then form homoheptamers. The "B" heptamer-receptor complex then acts as a docking platform that subsequently binds and allows the translocation of an enzymatic "A" component(s) into the cytosol via receptor-mediated endocytosis. Once inside the cell's cytosol,"A" components inhibit normal cell function by, for example, ADP-ribosylation of G-actin, or increasing intracellular levels of cyclic AMP (cAMP). See Barth et al. (2004) *Microbiol Mol Biol Rev* 68:373-402, herein incorporated by reference in its entirety.

Aside from the A/B type binary toxins, other types of binary toxins that act as pesticidal proteins are known in the art. Cry34Ab1 and Cry35Ab1 comprise a binary toxin with pesticidal activity that was identified from strain PS149B1 (Ellis et al. (2002) *Appl Environ Microbiol.* 68:1137-45, herein incorporated by reference in its entirety). These toxins have molecular masses of approximately 14 and 44 kDa, respectively. Other binary toxins with similar organization and homology to Cry34Aa and Cry34Ab have been identified (Baum et al. (2004) *Appl Environ Microbiol.* 70:4889-98, herein incorporated by reference in its entirety).

BinA and BinB are proteins from *Bacillus sphaericus* that comprise a mosquitocidal binary toxin protein (Baumann et al. (1991) *Micriobiol. Rev.* 55:425-36). Cry35 exhibits amino acid similarity to these BinA and BinB proteins. Cry36 (ET69) and Cry38 (ET75) (International Patent Application No. WO/00/66742-B, herein incorporated by reference in its entirety) are independently isolated peptides that also exhibit amino acid similarity to BinA and BinB, and thus are likely to comprise binary toxins.

In various embodiments, VIP-like or binary-like sequences encompassed herein include the nucleotide sequences set forth in SEQ ID NO:21, 22, 23, and 24, the amino acid sequences set forth in SEQ ID NO:70, 71, 72, and 73, and biologically-active variants and fragments thereof.

MTX-Like Sequences

In yet another embodiment, the sequences encompassed herein are MTX-like sequences. The term "MTX" is used in the art to delineate a set of pesticidal proteins that are produced by *Bacillus sphaericus*. The first of these, often referred to in the art as MTX1, is synthesized as a paraspora1 crystal which is toxic to mosquitoes. The major components of the crystal are two proteins of 51 and 42 kDa, Since the presence of both proteins are required for toxicity, MTX1 is considered a "binary" toxin (Baumann et al. (1991) *Microbiol. Rev.* 55:425-436).

By analysis of different *Bacillus sphaericus* strains with differing toxicities, two new classes of MTX toxins have been identified. MTX2 and MTX3 represent separate, related classes of pesticidal toxins that exhibit pesticidal activity. See, for example, Baumann et al. (1991) *Microbiol. Rev.* 55:425-436, herein incorporated by reference in its entirety. MTX2 is a 100-kDa toxin. More recently MTX3 has been identified as a separate toxin, though the amino acid sequence of MTX3 from *B. sphaericus* is 38% identitical to the MTX2 toxin of *B. sphaericus* SSII-1 (Liu, et al. (1996) *Appl. Environ. Microbiol.* 62: 2174-2176). Mtx toxins may be useful for both increasing the insecticidal activity of *B. sphaericus* strains and managing the evolution of resistance to the Bin toxins in mosquito populations (Wirth et al. (2007) Appl Environ Microbiol 73(19):6066-6071).

In various embodiments, the MTX-like sequences include the nucleotide sequences set forth in SEQ ID NO:25, 26, 27, 28, and 29, the amino acid sequences set forth in SEQ ID NO:74, 75, 76, 77, and 78, and biologically-active variants and fragments thereof.

Non-Cry Toxin

The present invention further comprises toxin sequences that are not delta-endotoxins, but have been isolated from *Bacillus*. In one embodiment, these toxins have homology to phosphatidylinositol phosphodiesterases (also referred to as phosphatidylinositol-specific phospholipase C (PI-PLC)). Phosphatidylinositol phosphodiesterase cleaves glycosylphosphatidylinositol (GPI) and phosphatidylinositol (PI) anchors. These proteins contain a PI-PLC X-box domain, and have been isolated from cultures of *Bacillus cereus, Bacillus thuringiensis, Staphylococcus aureus*, and *Clostridium novyi*, which secrete the enzyme across the bacterial membrane into the culture medium. The role of amino acid residues located in the active site pocket of phosphatidylinositol-specific phospholipase C(PI-PLC) from *Bacillus cereus* (Heinz et al. (1995) EMBO J. 14, 3855-3863, herein incorporated by reference in its entirety) was investigated by site-directed mutagenesis, kinetics, and crystal structure analysis (Gassler et al. (1997) Biochemistry 36:12802-12813, herein incorporated by reference in its entirety).

In various embodiments, the toxin sequences disclosed herein include the nucleotide sequences set forth in SEQ ID NO:30, the amino acid sequence set forth in SEQ ID NO:79, and biologically-active variants and fragments thereof.

Thus, provided herein are families of novel isolated nucleotide sequences that confer pesticidal activity. Also provided are the amino acid sequences of the toxin proteins. The protein resulting from translation of this gene allows cells to control or kill pests that ingest it.

cry55 Homologs

In another embodiment, the sequences disclosed herein are cry55 homologs. In some embodiments, the cry55 homologs include the nucleotide sequences set forth in SEQ ID NO:43 and 44, the amino acid sequences set forth in SEQ ID NO:92 and 93, and biologically-active variants and fragments thereof cry15A Homologs In another embodiment, the sequences disclosed herein are cry15A homologs. Cry15A toxins have been shown to have activity against lepidopteran pests (Rang et al. (2000) Curr Microbiol. 40(3):200-4). In some embodiments, the cry1SA homologs include the nucleotide sequences set forth in SEQ ID NO:45, 46, and 47, the amino acid sequences set forth in SEQ ID NO:94, 95, and 96, and biologically-active variants and fragments thereof.

Isolated Nucleic Acid Molecules, and Variants and Fragments Thereof

One aspect of the invention pertains to isolated or recombinant nucleic acid molecules comprising nucleotide sequences encoding toxin proteins and polypeptides or biologically active portions thereof, as well as nucleic acid molecules sufficient for use as hybridization probes to identify toxin encoding nucleic acids. As used herein, the term "nucleic acid molecule" is intended to include DNA molecules (e.g., recombinant DNA, cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" or "purified" nucleic acid molecule or protein, or biologically active portion thereof, is substantially free of other cellular material, or culture medium when produced by recombinant techniques, or substantially free of chemical precursors or other chemicals when chemically synthesized. Preferably, an "isolated" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the invention, "isolated" when used to refer to nucleic acid molecules excludes isolated chromosomes. For example, in various embodiments, the isolated toxin encoding nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A toxin protein that is substantially free of cellular material includes preparations of protein having less than about 30%, 20%, 10%, or 5% (by dry weight) of non-toxin protein (also referred to herein as a "contaminating protein").

Nucleotide sequences encoding the proteins of the present invention include the sequence set forth in SEQ ID NO:1-47, and variants, fragments, and complements thereof. By "complement" is intended a nucleotide sequence that is sufficiently complementary to a given nucleotide sequence such that it can hybridize to the given nucleotide sequence to thereby form a stable duplex. The corresponding amino acid sequence for the toxin protein encoded by this nucleotide sequence are set forth in SEQ ID NO:50-96.

Nucleic acid molecules that are fragments of these toxin encoding nucleotide sequences are also encompassed by the present invention. By "fragment" is intended a portion of the nucleotide sequence encoding a toxin protein. A fragment of a nucleotide sequence may encode a biologically active portion of a toxin protein, or it may be a fragment that can be used as a hybridization probe or PCR primer using methods disclosed below. Nucleic acid molecules that are fragments of a toxin nucleotide sequence comprise at least about 50, 100, 200, 300, 400, 500, 600, 700, 800, 900, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300, 2350, 2400, 2450, 2500, 2550, 2600, 2650, 2700, 2750, 2800, 2850, 2900, 2950, 3000, 3050, 3100, 3150, 3200, 3250, 3300, 3350 contiguous nucleotides, or up to the number of nucleotides present in a full-length toxin encoding nucleotide sequence disclosed herein depending upon the intended use. By "contiguous" nucleotides is intended nucleotide residues that are immediately adjacent to one another. Fragments of the nucleotide sequences of the present invention will encode protein fragments that retain the biological activity of the toxin protein and, hence, retain pesticidal activity. By "retains activity" is intended that the fragment will have at least about 30%, at least about 50%, at least about 70%, 80%, 90%, 95% or higher of the pesticidal activity of the toxin protein. Methods for measuring pesticidal activity are well known in the art. See, for example, Czapla and Lang (1990) J. Econ. Entomol. 83:2480-2485; Andrews et al. (1988) Biochem. J. 252:199-206; Marrone et al. (1985) J. of Economic Entomology 78:290-293; and U.S. Pat. No. 5,743,477, all of which are herein incorporated by reference in their entirety.

A fragment of a toxin encoding nucleotide sequence that encodes a biologically active portion of a protein of the invention will encode at least about 15, 25, 30, 50, 75, 100, 125, 150, 175, 200, 250, 300, 350, 400, 450, 500, 550, 600, 650, 700, 750, 800, 850, 900, 950, 1000, 1050, 1100 contiguous amino acids, or up to the total number of amino acids present in a full-length toxin protein of the invention. In some embodiments, the fragment is a proteolytic cleavage fragment. For example, the proteolytic cleavage fragment may have an N-terminal or a C-terminal truncation of at least about 100 amino acids, about 120, about 130, about 140, about 150, or about 160 amino acids relative to SEQ ID NO:50-96. In some embodiments, the fragments encompassed herein result from the removal of the C-terminal crystallization domain, e.g., by proteolysis or by insertion of a stop codon in the coding sequence.

Preferred toxin proteins of the present invention are encoded by a nucleotide sequence sufficiently identical to the nucleotide sequence of SEQ ID NO:1-47. By "sufficiently identical" is intended an amino acid or nucleotide sequence that has at least about 60% or 65% sequence identity, about 70% or 75% sequence identity, about 80% or 85% sequence identity, about 90%, 91%, 92%, 93%, 94%, 95%, 96%, 97%, 98%, 99% or greater sequence identity compared to a reference sequence using one of the alignment programs described herein using standard parameters. One of skill in the art will recognize that these values can be appropriately adjusted to determine corresponding identity of proteins encoded by two nucleotide sequences by taking into account codon degeneracy, amino acid similarity, reading frame positioning, and the like.

To determine the percent identity of two amino acid sequences or of two nucleic acids, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of one of SEQ ID NO:1-47, or across the entirety of one of SEQ ID NO:50-96). The percent identity between two sequences can be determined using techniques similar to those described below, with or without allowing gaps. In calculating percent identity, typically exact matches are counted.

The determination of percent identity between two sequences can be accomplished using a mathematical algorithm. A nonlimiting example of a mathematical algorithm utilized for the comparison of two sequences is the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877. Such an algorithm is incorporated into the BLASTN and BLASTX programs of Altschul et al. (1990) *J. Mol. Biol.* 215:403. BLAST nucleotide searches can be performed with the BLASTN program, score=100, wordlength=12, to obtain nucleotide sequences homologous to toxin-like nucleic acid molecules of the invention. BLAST protein searches can be performed with the BLASTX program, score=50, wordlength=3, to obtain amino acid sequences homologous to toxin protein molecules of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-Blast can be used to perform an iterated search that detects distant relationships between molecules. See Altschul et al. (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins et al. (1994) *Nucleic Acids Res.* 22:4673-4680). ClustalW compares sequences and aligns the entirety of the amino acid or DNA sequence, and thus can provide data about the sequence conservation of the entire amino acid sequence. The ClustalW algorithm is used in several commercially available DNA/amino acid analysis software packages, such as the ALIGNX module of the Vector NTI Program Suite (Invitrogen Corporation, Carlsbad, Calif.). After alignment of amino acid sequences with ClustalW, the percent amino acid identity can be assessed. A nonlimiting example of a software program useful for analysis of ClustalW alignments is GENEDOC™. GENEDOC™(Karl Nicholas) allows assessment of amino acid (or DNA) similarity and identity between multiple proteins. Another non-limiting example of a mathematical algorithm utilized for the comparison of sequences is the algorithm of Myers and Miller (1988) *CABIOS* 4:11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12, and a gap penalty of 4 can be used.

Unless otherwise stated, GAP Version 10, which uses the algorithm of Needleman and Wunsch (1970) *J. Mol. Biol.* 48(3):443-453, will be used to determine sequence identity or similarity using the following parameters: % identity and % similarity for a nucleotide sequence using GAP Weight of 50 and Length Weight of 3, and the nwsgapdna.cmp scoring matrix; % identity or % similarity for an amino acid sequence using GAP weight of 8 and length weight of 2, and the BLOSUM62 scoring program. Equivalent programs may also be used. By "equivalent program" is intended any sequence comparison program that, for any two sequences in question, generates an alignment having identical nucleotide residue matches and an identical percent sequence identity when compared to the corresponding alignment generated by GAP Version 10.

The invention also encompasses variant nucleic acid molecules. "Variants" of the toxin encoding nucleotide sequences include those sequences that encode the toxin proteins disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleotide sequences also include synthetically derived nucleotide sequences that have been generated, for example, by using site-directed mutagenesis but which still encode the toxin proteins disclosed in the present invention as discussed below. Variant proteins encompassed by the present invention are biologically active, that is they continue to possess the desired biological activity of the native protein, that is, retaining pesticidal activity. By "retains activity" is intended that the variant will have at least about 30%, at least about 50%, at least about 70%, or at least about 80% of the pesticidal activity of the native protein. Methods for measuring pesticidal activity are well known in the art. See, for example, Czapla and Lang (1990) *J. Econ. Entomol.* 83: 2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

The skilled artisan will further appreciate that changes can be introduced by mutation of the nucleotide sequences of the invention thereby leading to changes in the amino acid sequence of the encoded toxin proteins, without altering the biological activity of the proteins. Thus, variant isolated nucleic acid molecules can be created by introducing one or more nucleotide substitutions, additions, or deletions into the corresponding nucleotide sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleotide sequences are also encompassed by the present invention.

For example, conservative amino acid substitutions may be made at one or more predicted, nonessential amino acid residues. A "nonessential" amino acid residue is a residue that can be altered from the wild-type sequence of a toxin protein without altering the biological activity, whereas an "essential" amino acid residue is required for biological activity. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Delta-endotoxins generally have five conserved sequence domains, and three conserved structural domains (see, for example, de Maagd et al. (2001) *Trends Genetics* 17:193-199). The first conserved structural domain consists of seven alpha helices and is involved in membrane insertion and pore formation. Domain II consists of three beta-sheets arranged in a Greek key configuration, and domain III consists of two antiparallel beta-sheets in "jelly-roll" formation (de Maagd et al., 2001, supra). Domains II and III are involved in receptor recognition and binding, and are therefore considered determinants of toxin specificity.

Amino acid substitutions may be made in nonconserved regions that retain function. In general, such substitutions would not be made for conserved amino acid residues, or for amino acid residues residing within a conserved motif, where such residues are essential for protein activity. Examples of residues that are conserved and that may be essential for protein activity include, for example, residues that are identical between all proteins contained in an alignment of the amino acid sequences of the present invention and known toxin sequences. Examples of residues that are conserved but that may allow conservative amino acid substitutions and still retain activity include, for example, residues that have only conservative substitutions between all proteins contained in an alignment of the amino acid sequences of the present invention and known toxin sequences. However, one of skill in the art would understand that functional variants may have minor conserved or nonconserved alterations in the conserved residues.

Alternatively, variant nucleotide sequences can be made by introducing mutations randomly along all or part of the coding sequence, such as by saturation mutagenesis, and the resultant mutants can be screened for ability to confer toxin activity to identify mutants that retain activity. Following mutagenesis, the encoded protein can be expressed recombinantly, and the activity of the protein can be determined using standard assay techniques.

Using methods such as PCR, hybridization, and the like corresponding toxin sequences can be identified, such sequences having substantial identity to the sequences of the invention. See, for example, Sambrook and Russell (2001) *Molecular Cloning: A Laboratory Manual*. (Cold Spring Harbor Laboratory Press, Cold Spring Harbor, N.Y.) and Innis, et al. (1990) *PCR Protocols: A Guide to Methods and Applications* (Academic Press, NY).

In a hybridization method, all or part of the toxin nucleotide sequence can be used to screen cDNA or genomic libraries. Methods for construction of such cDNA and genomic libraries are generally known in the art and are disclosed in Sambrook and Russell, 2001, supra. The so-called hybridization probes may be genomic DNA fragments, cDNA fragments, RNA fragments, or other oligonucleotides, and may be labeled with a detectable group such as $^{32}P$, or any other detectable marker, such as other radioisotopes, a fluorescent compound, an enzyme, or an enzyme co-factor. Probes for hybridization can be made by labeling synthetic oligonucleotides based on the known toxin-encoding nucleotide sequence disclosed herein. Degenerate primers designed on the basis of conserved nucleotides or amino acid residues in the nucleotide sequence or encoded amino acid sequence can additionally be used. The probe typically comprises a region of nucleotide sequence that hybridizes under stringent conditions to at least about 12, at least about 25, at least about 50, 75, 100, 125, 150, 175, 200, 250, 300, 350, or 400 consecutive nucleotides of toxin encoding nucleotide sequence of the invention or a fragment or variant thereof. Methods for the preparation of probes for hybridization are generally known in the art and are disclosed in Sambrook and Russell, 2001, supra herein incorporated by reference.

For example, an entire toxin sequence disclosed herein, or one or more portions thereof, may be used as a probe capable of specifically hybridizing to corresponding toxin-like sequences and messenger RNAs. To achieve specific hybridization under a variety of conditions, such probes include sequences that are unique and are preferably at least about 10 nucleotides in length, or at least about 20 nucleotides in length. Such probes may be used to amplify corresponding toxin sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Cold Spring Harbor, N.Y.).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the $T_m$ can be approximated from the equation of Meinkoth and Wahl (1984) *Anal. Biochem.* 138:267-284: $T_m=81.5°$ C.$+16.6$ (log M)$+0.41$ (% GC)$-0.61$ (% form)$-500$/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with $\geq 90\%$ identity are sought, the $T_m$ can be decreased 10° C. Generally, stringent conditions are selected to be about 5° C. lower than the thermal melting point ($T_m$) for the specific sequence and its complement at a defined ionic strength and pH.

However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is preferred to increase the SSC concentration so that a higher temperature can be used. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Cold Spring Harbor, N.Y.).

Isolated Proteins and Variants and Fragments Thereof

Toxin proteins are also encompassed within the present invention. By "toxin protein" is intended a protein having the amino acid sequence set forth in SEQ ID NO:50-96. Fragments, biologically active portions, and variants thereof are also provided, and may be used to practice the methods of the present invention.

"Fragments" or "biologically active portions" include polypeptide fragments comprising amino acid sequences sufficiently identical to the amino acid sequence set forth in any of SEQ ID NO:50-96 and that exhibit pesticidal activity. A biologically active portion of a toxin protein can be a polypeptide that is, for example, 10, 25, 50, 100 or more amino acids in length. Such biologically active portions can be prepared by recombinant techniques and evaluated for pesticidal activity. Methods for measuring pesticidal activity are well known in the art. See, for example, Czapla and Lang (1990) *J. Econ. Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety. As used here, a fragment comprises at least 8 contiguous amino acids of SEQ ID NO:50-96. The invention encompasses other fragments, however, such as any fragment in the protein greater than about 10, 20, 30, 50, 100, 150, 200, 250, 300, 350, 400, 400, 450, 500, 550, 600, 650, 700, 750, 800, 850, 900, 950, 1000, 1050, 1100, 1150, 1200, 1250, or 1300 amino acids.

By "variants" is intended proteins or polypeptides having an amino acid sequence that is at least about 60%, 65%, about 70%, 75%, about 80%, 85%, about 90%, 91%, 92%, 93%, 94%, 95%, 96%, 97%, 98% or 99% identical to the amino acid sequence of any of SEQ ID NO:50-96. Variants also include polypeptides encoded by a nucleic acid molecule that hybridizes to the nucleic acid molecule of SEQ ID NO:1-47, or a complement thereof, under stringent conditions. Variants include polypeptides that differ in amino acid sequence due to mutagenesis. Variant proteins encompassed by the present invention are biologically active, that is they continue to possess the desired biological activity of the native protein, that is, retaining pesticidal activity. Methods for measuring pesticidal activity are well known in the art. See, for example, Czapla and Lang (1990) *J. Econ. Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

Bacterial genes, such as the axmi genes of this invention, quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. Furthermore, it is not often determined a priori which of these codons are used naturally in the bacterium. Thus, it is understood that use of one of the alternate methionine codons may also lead to generation of toxin proteins that encode pesticidal activity. These toxin proteins are encompassed in the present invention and may be used in the methods of the present invention.

Antibodies to the polypeptides of the present invention, or to variants or fragments thereof, are also encompassed. Methods for producing antibodies are well known in the art (see, for example, Harlow and Lane (1988) *Antibodies: A Laboratory Manual*, Cold Spring Harbor Laboratory, Cold Spring Harbor, N.Y.; U.S. Pat. No. 4,196,265).

Altered or Improved Variants

It is recognized that DNA sequences of a toxin may be altered by various methods, and that these alterations may result in DNA sequences encoding proteins with amino acid sequences different than that encoded by a toxin of the present invention. This protein may be altered in various ways including amino acid substitutions, deletions, truncations, and insertions of one or more amino acids of SEQ ID NO:50-96, including up to about 2, about 3, about 4, about 5, about 6, about 7, about 8, about 9, about 10, about 15, about 20, about 25, about 30, about 35, about 40, about 45, about 50, about 55, about 60, about 65, about 70, about 75, about 80, about 85, about 90, about 100, about 105, about 110, about 115, about 120, about 125, about 130 or more amino acid substitutions, deletions or insertions.

Methods for such manipulations are generally known in the art. For example, amino acid sequence variants of a toxin protein can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of a toxin to confer pesticidal activity may be improved by the use of such techniques upon the compositions of this invention. For example, one may express a toxin in host cells that exhibit high rates of base misincorporation during DNA replication, such as XL-1 Red (Stratagene). After propagation in such strains, one can isolate the toxin DNA (for example by preparing plasmid DNA, or by amplifying by PCR and cloning the resulting PCR fragment into a vector), culture the toxin mutations in a non-mutagenic strain, and identify mutated toxin genes with pesticidal activity, for example by performing an assay to test for pesticidal activity. Generally, the protein is mixed and used in feeding assays. See, for example Marrone et al. (1985) *J. of Economic Entomology* 78:290-293. Such assays can include contacting plants with one or more pests and determining the plant's ability to survive and/or cause the death of the pests. Examples of mutations that result in increased toxicity are found in Schnepf et al. (1998) *Microbiol. Mol. Biol. Rev.* 62:775-806.

Alternatively, alterations may be made to the protein sequence of many proteins at the amino or carboxy terminus without substantially affecting activity. This can include insertions, deletions, or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity, or epitope to facilitate either protein purification, protein detection, or other experimental uses known in the art (3) target secretion or translation of a protein to a subcellular organelle, such as the periplasmic space of Gram-negative bacteria, or the endoplasmic reticulum of eukaryotic cells, the latter of which often results in glycosylation of the protein.

Variant nucleotide and amino acid sequences of the present invention also encompass sequences derived from mutagenic and recombinogenic procedures such as DNA shuffling. With such a procedure, one or more different toxin protein coding regions can be used to create a new toxin protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a toxin gene of the invention and other known toxin genes to obtain a new gene coding for a protein with an improved property of interest, such as an increased insecticidal activity. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

Domain swapping or shuffling is another mechanism for generating altered delta-endotoxin proteins. Domains II and III may be swapped between delta-endotoxin proteins, resulting in hybrid or chimeric toxins with improved pesticidal activity or target spectrum. Methods for generating recombinant proteins and testing them for pesticidal activity are well known in the art (see, for example, Naimov et al. (2001) *Appl. Environ. Microbiol.* 67:5328-5330; de Maagd et al. (1996) *Appl. Environ. Microbiol.* 62:1537-1543; Ge et al. (1991) *J. Biol. Chem.* 266:17954-17958; Schnepf et al. (1990) *J. Biol. Chem.* 265:20923-20930; Rang et al. 91999) *Appl. Environ. Microbiol.* 65:2918-2925).

Vectors

A toxin sequence of the invention may be provided in an expression cassette for expression in a plant of interest. By "plant expression cassette" is intended a DNA construct that is capable of resulting in the expression of a protein from an open reading frame in a plant cell. Typically these contain a promoter and a coding sequence. Often, such constructs will also contain a 3' untranslated region. Such constructs may contain a "signal sequence" or "leader sequence" to facilitate co-translational or post-translational transport of the peptide to certain intracellular structures such as the chloroplast (or other plastid), endoplasmic reticulum, or Golgi apparatus.

By "signal sequence" is intended a sequence that is known or suspected to result in cotranslational or post-translational peptide transport across the cell membrane. In eukaryotes, this typically involves secretion into the Golgi apparatus, with some resulting glycosylation. By "leader sequence" is intended any sequence that when translated, results in an amino acid sequence sufficient to trigger co-translational transport of the peptide chain to a sub-cellular organelle. Thus, this includes leader sequences targeting transport and/or glycosylation by passage into the endoplasmic reticulum, passage to vacuoles, plastids including chloroplasts, mitochondria, and the like.

By "plant transformation vector" is intended a DNA molecule that is necessary for efficient transformation of a plant cell. Such a molecule may consist of one or more plant expression cassettes, and may be organized into more than one "vector" DNA molecule. For example, binary vectors are plant transformation vectors that utilize two non-contiguous DNA vectors to encode all requisite cis- and trans-acting functions for transformation of plant cells (Hellens and Mullineaux (2000) *Trends in Plant Science* 5:446-451). "Vector" refers to a nucleic acid construct designed for transfer between different host cells. "Expression vector" refers to a vector that has the ability to incorporate, integrate and express heterologous DNA sequences or fragments in a foreign cell. The cassette will include 5' and 3' regulatory sequences operably linked to a sequence of the invention. By "operably linked" is intended a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The cassette may additionally contain at least one additional gene to be cotransformed into the organism. Alternatively, the additional gene(s) can be provided on multiple expression cassettes.

"Promoter" refers to a nucleic acid sequence that functions to direct transcription of a downstream coding sequence. The promoter together with other transcriptional and translational regulatory nucleic acid sequences (also termed "control sequences") are necessary for the expression of a DNA sequence of interest.

Such an expression cassette is provided with a plurality of restriction sites for insertion of the toxin sequence to be under the transcriptional regulation of the regulatory regions.

The expression cassette will include in the 5'-3' direction of transcription, a transcriptional and translational initiation region (i.e., a promoter), a DNA sequence of the invention, and a translational and transcriptional termination region (i.e., termination region) functional in plants. The promoter may be native or analogous, or foreign or heterologous, to the plant host and/or to the DNA sequence of the invention. Additionally, the promoter may be the natural sequence or alternatively a synthetic sequence. Where the promoter is "native" or "homologous" to the plant host, it is intended that the promoter is found in the native plant into which the promoter is introduced. Where the promoter is "foreign" or "heterologous" to the DNA sequence of the invention, it is intended that the promoter is not the native or naturally occurring promoter for the operably linked DNA sequence of the invention.

The termination region may be native with the transcriptional initiation region, may be native with the operably linked DNA sequence of interest, may be native with the plant host, or may be derived from another source (i.e., foreign or heterologous to the promoter, the DNA sequence of interest, the plant host, or any combination thereof). Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acid Res.* 15:9627-9639.

Where appropriate, the gene(s) may be optimized for increased expression in the transformed host cell. That is, the genes can be synthesized using host cell-preferred codons for improved expression, or may be synthesized using codons at a host-preferred codon usage frequency. Generally, the GC content of the gene will be increased. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

In one embodiment, the toxin is targeted to the chloroplast for expression. In this manner, where the toxin is not directly inserted into the chloroplast, the expression cassette will additionally contain a nucleic acid encoding a transit peptide to direct the toxin to the chloroplasts. Such transit peptides are known in the art. See, for example, Von Heijne et al. (1991) *Plant Mol. Biol. Rep.* 9:104-126; Clark et al. (1989) *J. Biol. Chem.* 264:17544-17550; Della-Cioppa et al. (1987) *Plant Physiol.* 84:965-968; Romer et al. (1993) *Biochem. Biophys. Res. Commun.* 196:1414-1421; and Shah et al. (1986) *Science* 233:478-481.

The toxin gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

Plant Transformation

Methods of the invention involve introducing a nucleotide construct into a plant. By "introducing" is intended to present to the plant the nucleotide construct in such a manner that the construct gains access to the interior of a cell of the plant. The methods of the invention do not require that a particular method for introducing a nucleotide construct to a plant is used, only that the nucleotide construct gains access to the interior of at least one cell of the plant. Methods for introducing nucleotide constructs into plants are known in the art including, but not limited to, stable transformation methods, transient transformation methods, and virus-mediated methods.

By "plant" is intended whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic plants" or "transformed plants" or "stably transformed" plants or cells or tissues refers to plants that have incorporated or integrated exogenous nucleic acid sequences or DNA fragments into the plant cell. These nucleic acid sequences include those that are exogenous, or not present in the untransformed plant cell, as well as those that may be endogenous, or present in the untransformed plant cell. "Heterologous" generally refers to the nucleic acid sequences that are not endogenous to the cell or part of the native genome in which they are present, and have been added to the cell by infection, transfection, microinjection, electroporation, microprojection, or the like.

The transgenic plants of the invention express one or more of the pesticidal sequences disclosed herein. In various embodiments, the transgenic plant further comprises one or more additional genes for insect resistance, for example, one or more additional genes for controlling coleopteran, lepidopteran, heteropteran, or nematode pests. It will be understood by one of skill in the art that the transgenic plant may comprise any gene imparting an agronomic trait of interest.

Transformation of plant cells can be accomplished by one of several techniques known in the art. The toxin gene of the invention may be modified to obtain or enhance expression in plant cells. Typically a construct that expresses such a protein would contain a promoter to drive transcription of the gene, as well as a 3' untranslated region to allow transcription termination and polyadenylation. The organization of such constructs is well known in the art. In some instances, it may be useful to engineer the gene such that the resulting peptide is secreted, or otherwise targeted within the plant cell. For example, the gene can be engineered to contain a signal peptide to facilitate transfer of the peptide to the endoplasmic reticulum. It may also be preferable to engineer the plant expression cassette to contain an intron, such that mRNA processing of the intron is required for expression.

Typically this "plant expression cassette" will be inserted into a "plant transformation vector". This plant transformation vector may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the toxin are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g. immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g. Hiei et al. (1994) *The Plant Journal* 6:271-282; Ishida et al. (1996) *Nature Biotechnology* 14:745-750). Explants are typically transferred to a fresh supply of the same medium and cultured routinely. A general description of the techniques and methods for generating transgenic plants are found in Ayres and Park (1994) *Critical Reviews in Plant Science* 13:219-239 and Bommineni and Jauhar (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

Transformation protocols as well as protocols for introducing nucleotide sequences into plants may vary depending on the type of plant or plant cell, i.e., monocot or dicot, targeted for transformation. Generation of transgenic plants may be performed by one of several methods, including, but not limited to, microinjection, electroporation, direct gene transfer, introduction of heterologous DNA by *Agrobacterium* into plant cells (*Agrobacterium*-mediated transformation), bombardment of plant cells with heterologous foreign DNA adhered to particles, ballistic particle acceleration, aerosol beam transformation (U.S. Published Application No. 20010026941; U.S. Pat. No. 4,945,050; International Publication No. WO 91/00915; U.S. Published Application No. 2002015066), Lec1 transformation, and various other non-particle direct-mediated methods to transfer DNA.

Methods for transformation of chloroplasts are known in the art. See, for example, Svab et al. (1990) *Proc. Natl. Acad. Sci. USA* 87:8526-8530; Svab and Maliga (1993) *Proc. Natl. Acad. Sci. USA* 90:913-917; Svab and Maliga (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) *Proc. Natl. Acad. Sci. USA* 91:7301-7305.

Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell (2001) *Molecular Cloning: A Laboratory Manual*. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, 2001, supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled $^{32}P$ target DNA fragment to confirm the integration of introduced gene into the plant genome according to standard techniques (Sambrook and Russell, 2001, supra).

In Northern blot analysis, RNA is isolated from specific tissues of transformant, fractionated in a formaldehyde agarose gel, and blotted onto a nylon filter according to standard procedures that are routinely used in the art (Sambrook and Russell, 2001, supra). Expression of RNA encoded by the toxin is then tested by hybridizing the filter to a radioactive probe derived from a toxin, by methods known in the art (Sambrook and Russell, 2001, supra).

Western blot, biochemical assays and the like may be carried out on the transgenic plants to confirm the presence of protein encoded by the toxin gene by standard procedures (Sambrook and Russell, 2001, supra) using antibodies that bind to one or more epitopes present on the toxin protein.

Pesticidal Activity in Plants

In another aspect of the invention, one may generate transgenic plants expressing a toxin that has pesticidal activity. Methods described above by way of example may be utilized to generate transgenic plants, but the manner in which the transgenic plant cells are generated is not critical to this invention. Methods known or described in the art such as *Agrobacterium*-mediated transformation, biolistic transformation, and non-particle-mediated methods may be used at the discretion of the experimenter. Plants expressing a toxin may be isolated by common methods described in the art, for example by transformation of callus, selection of transformed callus, and regeneration of fertile plants from such transgenic callus. In such process, one may use any gene as a selectable marker so long as its expression in plant cells confers ability to identify or select for transformed cells.

A number of markers have been developed for use with plant cells, such as resistance to chloramphenicol, the aminoglycoside G418, hygromycin, or the like. Other genes that encode a product involved in chloroplast metabolism may also be used as selectable markers. For example, genes that provide resistance to plant herbicides such as glyphosate, bromoxynil, or imidazolinone may find particular use. Such genes have been reported (Stalker et al. (1985) *J. Biol. Chem.* 263:6310-6314 (bromoxynil resistance nitrilase gene); and Sathasivan et al. (1990) *Nucl. Acids Res.* 18:2188 (AHAS imidazolinone resistance gene). Additionally, the genes disclosed herein are useful as markers to assess transformation of bacterial or plant cells. Methods for detecting the presence of a transgene in a plant, plant organ (e.g., leaves, stems, roots, etc.), seed, plant cell, propagule, embryo or progeny of the same are well known in the art. In one embodiment, the presence of the transgene is detected by testing for pesticidal activity.

Fertile plants expressing a toxin may be tested for pesticidal activity, and the plants showing optimal activity selected for further breeding. Methods are available in the art to assay for pest activity. Generally, the protein is mixed and used in feeding assays. See, for example Marrone et al. (1985) *J. of Economic Entomology* 78:290-293.

The present invention may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, papaya, cashew, *macadamia*, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, hydrangea, hibiscus, roses, tulips, daffodils, petunias, carnation, poinsettia, and chrysanthemum. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape., etc.).

Use in Pest Control

General methods for employing strains comprising a nucleotide sequence of the present invention, or a variant thereof, in pesticide control or in engineering other organisms as pesticidal agents are known in the art. See, for example U.S. Pat. No. 5,039,523 and EP 0480762A2.

The *Bacillus* strains containing a nucleotide sequence of the present invention, or a variant thereof, or the microorganisms that have been genetically altered to contain a pesticidal gene and protein may be used for protecting agricultural crops and products from pests. In one aspect of the invention, whole, i.e., unlysed, cells of a toxin (pesticide)-producing organism are treated with reagents that prolong the activity of the toxin produced in the cell when the cell is applied to the environment of target pest(s).

Alternatively, the pesticide is produced by introducing a toxin gene into a cellular host. Expression of the toxin gene results, directly or indirectly, in the intracellular production and maintenance of the pesticide. In one aspect of this invention, these cells are then treated under conditions that prolong the activity of the toxin produced in the cell when the cell is applied to the environment of target pest(s). The resulting product retains the toxicity of the toxin. These naturally encapsulated pesticides may then be formulated in accordance with conventional techniques for application to the environment hosting a target pest, e.g., soil, water, and foliage of plants. See, for example EPA 0192319, and the references cited therein. Alternatively, one may formulate the cells expressing a gene of this invention such as to allow application of the resulting material as a pesticide.

Pesticidal Compositions

The active ingredients of the present invention are normally applied in the form of compositions and can be applied to the crop area or plant to be treated, simultaneously or in succession, with other compounds. These compounds can be fertilizers, weed killers, cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient of the present invention or an agrochemical composition of the present invention that contains at least one of the pesticidal proteins produced by the bacterial strains of the present invention include leaf application, seed coating and soil application. The number of applications and the rate of application depend on the intensity of infestation by the corresponding pest.

The composition may be formulated as a powder, dust, pellet, granule, spray, emulsion, colloid, solution, or such like, and may be prepared by such conventional means as desiccation, lyophilization, homogenation, extraction, filtration, centrifugation, sedimentation, or concentration of a culture of cells comprising the polypeptide. In all such compositions that contain at least one such pesticidal polypeptide, the polypeptide may be present in a concentration of from about 1% to about 99% by weight.

Lepidopteran, dipteran, coleopteran, or nematode pests may be killed or reduced in numbers in a given area by the methods of the invention, or may be prophylactically applied to an environmental area to prevent infestation by a susceptible pest. Preferably the pest ingests, or is contacted with, a pesticidally-effective amount of the polypeptide. By "pesticidally-effective amount" is intended an amount of the pesticide that is able to bring about death to at least one pest, or to noticeably reduce pest growth, feeding, or normal physiological development. This amount will vary depending on such factors as, for example, the specific target pests to be controlled, the specific environment, location, plant, crop, or agricultural site to be treated, the environmental conditions, and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, crystal and/or spore suspension, or isolated protein component with the desired agriculturally-acceptable carrier. The compositions may be formulated prior to administration in an appropriate means such as lyophilized, freeze-dried, desiccated, or in an aqueous carrier, medium or suitable diluent, such as saline or other buffer. The formulated compositions may be in the form of a dust or granular material, or a suspension in oil (vegetable or mineral), or water or oil/water emulsions, or as a wettable powder, or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference.

Alternatively, the toxin genes could be cloned in *Pseudomonas* spp., thus expressing the proteins and microencapsulating them in the bacterial cell wall. Microencapsulated toxin could be used in spray applications alone or in rotations with *B. thuringiensis*-based insecticides containing other toxins.

The plants can also be treated with one or more chemical compositions, including one or more herbicide, insecticides, or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halosulfuron Gowan, Paraquat, Propyzamide, Sethoxydim, Butafenacil, Halosulfuron, Indaziflam; Fruits/Vegetables Insecticides: Aldicarb, *Bacillus* thuriengiensis, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, Fluacrypyrim, Tolfenpyrad, Clothianidin, Spirodiclofen, Gamma-cyhalothrin, Spiromesifen, Spinosad, Rynaxypyr, Cyazypyr, Spinoteram, Triflumuron,Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, Ioxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S-)Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2(5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethyl)amino]furan-2 (5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides:
Carbofuran, Organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2(5H)-on.

"Pest" includes but is not limited to, insects, fungi, bacteria, nematodes, mites, ticks, and the like. Insect pests include insects selected from the orders Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, etc., particularly Coleoptera, Lepidoptera, and Diptera.

The order Coleoptera includes the suborders Adephaga and Polyphaga. Suborder Adephaga includes the superfamilies Caraboidea and Gyrinoidea, while suborder Polyphaga includes the superfamilies Hydrophiloidea, Staphylinoidea, Cantharoidea, Cleroidea, Elateroidea, Dascilloidea, Dryopoidea, Byrrhoidea, Cucujoidea, Meloidea, Mordelloidea, Tenebrionoidea, Bostrichoidea, Scarabaeoidea, Cerambycoidea, Chrysomeloidea, and Curculionoidea. Superfamily Caraboidea includes the families Cicindelidae, Carabidae, and Dytiscidae. Superfamily Gyrinoidea includes the family Gyrimidae. Superfamily Hydrophiloidea includes the family Hydrophilidae. Superfamily Staphylinoidea includes the families Silphidae and Staphylimidae. Superfamily Cantharoidea includes the families Cantharidae and Lampyridae. Superfamily Cleroidea includes the families Cleridae and Dermestidae. Superfamily Elateroidea includes the families Elateridae and Buprestidae. Superfamily Cucujoidea includes the family Coccinellidae. Superfamily Meloidea includes the family Meloidae. Superfamily Tenebrionoidea includes the family Tenebrionidae. Superfamily Scarabaeoidea includes the families Passalidae and Scarabaeidae. Superfamily Cerambycoidea includes the family Cerambycidae. Superfamily Chrysomeloidea includes the family Chrysomelidae. Superfamily Curculionoidea includes the families Curculionidae and Scolytidae.

The order Diptera includes the Suborders Nematocera, Brachycera, and Cyclorrhapha. Suborder Nematocera includes the families Tipulidae, Psychodidae, Culicidae, Ceratopogonidae, Chironomidae, Simuliidae, Bibionidae, and Cecidomyiidae. Suborder Brachycera includes the families Stratiomyidae, Tabanidae, Therevidae, Asilidae, Mydidae, Bombyliidae, and Dolichopodidae. Suborder Cyclorrhapha includes the Divisions Aschiza and Aschiza. Division Aschiza includes the families Phoridae, Syrphidae, and Conopidae. Division Aschiza includes the Sections Acalyptratae and Calyptratae. Section Acalyptratae includes the families Otitidae, Tephritidae, Agromyzidae, and Drosophilidae. Section Calyptratae includes the families Hippoboscidae, Oestridae, Tachimidae, Anthomyiidae, Muscidae, Calliphoridae, and Sarcophagidae.

The order Lepidoptera includes the families Papilionidae, Pieridae, Lycaenidae, Nymphalidae, Danaidae, Satyridae, Hesperiidae, Sphingidae, Saturniidae, Geometridae, Arctiidae, Noctuidae, Lymantriidae, Sesiidae, and Tineidae.

Nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

Insect pests of the invention for the major crops include: Maize: *Ostrinia Nubilalis*, European corn borer; *Agrotis ipsilon*, black cutworm; *Helicoverpa zea*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; *Diabrotica virgifera*, western corn rootworm; *Diabrotica longicornis* barberi, northern corn rootworm; *Diabrotica undecimpunctata howardi*, southern corn rootworm; *Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blot leafminer; *Anaphothrips obscrurus*, grass thrips; *Solenopsis milesta*, thief ant; *Tetranychus urticae*, twospotted spider mite; Sorghum: *Chilo partellus*, sorghum borer; *Spodoptera frugiperda*, fall armyworm; *Helicoverpa zea*, corn earworm; *Elasmopalpus lignosellus*, lesser cornstalk borer; *Feltia subterranea*, granulate cutworm; *Phyllophaga crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*; corn leaf aphid; *Sipha flava*, yellow sugarcane aphid; *Blissus leucopterus* leucopterus, chinch bug; *Contarinia sorghicola*, sorghum midge; *Tetranychus cinnabarinus*, carmine spider mite; *Tetranychus urticae*, twospotted spider mite; Wheat: *Pseudaletia unipunctata*, army worm; *Spodoptera frugiperda*, fall armyworm; *Elasmopalpus lignosellus*, lesser cornstalk borer; *Agrotis orthogonia*, western cutworm; *Elasmopalpus lignosellus*, lesser cornstalk borer; *Oulema melanopus*, cereal leaf beetle; *Hypera punctata*, clover leaf weevil; *Diabrotica undecimpunctata howardi*, southern corn rootworm; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarctate*, wheat bulb fly; *Frankliniella fusca*, tobacco thrips; *Cephus cinctus*, wheat stem sawfly; *Aceria tulipae*, wheat curl mite; Sunflower: *Suleima helianthana*, sunflower bud moth; *Homoeosoma electellum*, sunflower moth; *zygogramma exclamationis*, sunflower beetle; *Bothyrus gibbosus*, carrot beetle; *Neolasioptera murtfeldtiana*, sunflower seed midge; Cotton: *Heliothis virescens*, cotton budworm; *Helicoverpa zea*, cotton bollworm; *Spodoptera exigua*, beet armyworm; *Pectinophora gossypiella*, pink bollworm; *Anthonomus grandis*, boll weevil; *Aphis gossypii*, cotton aphid; *Pseudatomoscelis seriatus*, cotton fleahopper; *Trialeurodes abutilonea*, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion thrips; *Franklinkiella fusca*, tobacco thrips; *Tetranychus cinnabarinus*, carmine spider mite; *Tetranychus urticae*, twospotted spider mite; Rice: *Diatraea saccharalis*, sugarcane borer; *Spodoptera frugiperda*, fall armyworm; *Helicoverpa zea*, corn earworm; *Colaspis brunnea*, grape *colaspis; Lissorhoptrus oryzophilus*, rice water weevil; *Sitophilus oryzae*, rice weevil; *Nephotettix nigropictus*, rice leafhopper; *Blissus leucopterus* leucopterus, chinch bug; *Acrosternum hilare*, green stink bug; Soybean: *Pseudoplusia includens*, soybean looper; *Anticarsia gemmatalis*, velvetbean caterpillar; *Plathypena* scabs, green cloverworm; *Ostrinia nubilalis*, European corn borer; *Agrotis ipsilon*, black cutworm; *Spodoptera exigua*, beet armyworm; *Heliothis virescens*, cotton budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean thrips; *Thrips tabaci*, onion thrips; *Tetranychus turkestani*, strawberry spider mite; *Tetranychus urticae*, twospotted spider mite; Barley: *Ostrinia nubilalis*, European corn borer; *Agrotis ipsilon*, black cutworm; *Schizaphis graminum*, greenbug; *Blissus leucopterus* leucopterus, chinch bug; *Acrosternum hilare*, green stink bug; *Euschistus servus*, brown stink bug; *Delia platura*, seedcorn maggot; *Mayetiola destructor*, Hessian fly; *Petrobia latens*, brown wheat mite; Oil Seed Rape: *Brevicoryne brassicae*, cabbage aphid; *Phyllotreta cruciferae*, Flea beetle; *Mamestra configurata*, Bertha armyworm; *Plutella xylostella*, Diamond-back moth; *Delia* ssp., Root maggots.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which said polypeptide has pesticidal activity. In some embodiments, the polypeptide has pesticidal activity against a lepidopteran, coleopteran, dipteran, hemipteran, or nematode pest, and said field is infested with a lepidopteran, hemipteran, coleopteran, dipteran, or nematode pest.

As defined herein, the "yield" of the plant refers to the quality and/or quantity of biomass produced by the plant. By "biomass" is intended any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing a pesticidal protein disclosed herein. Expression of the pesticidal protein results in a reduced ability of a pest to infest or feed on the plant, thus improving plant yield.

The following examples are offered by way of illustration and not by way of limitation.

EXPERIMENTAL

Example 1

Identification of Novel Genes

Novel pesticidal genes are identified from the bacterial strains described herein using methods such as:

Method 1
- Preparation of extrachromosomal DNA from the strain, which includes plasmids that typically harbor delta-endotoxin genes
- Mechanical shearing of extrachromosomal DNA to generate size-distributed fragments
- Cloning of ~2 Kb to ~10 Kb fragments of extrachromosomal DNA
- Outgrowth of ~1500 clones of the extrachromosomal DNA
- Partial sequencing of the 1500 clones using primers specific to the cloning vector (end reads)
- Identification of putative toxin genes via homology analysis via the MiDAS approach (as described in U.S. Patent Publication No. 20040014091, which is herein incorporated by reference in its entirety)
- Sequence finishing (walking) of clones containing fragments of the putative toxin genes of interest Method 2
- Preparation of extrachromosomal DNA from the strain (which contains a mixture of some or all of the following: plasmids of various size; phage chromosomes; genomic DNA fragments not separated by the purification protocol; other uncharacterized extrachromosomal molecules)
- Mechanical or enzymatic shearing of the extrachromosomal DNA to generate size-distributed fragments
- Sequencing of the fragmented DNA by high-throughput pyrosequencing methods
- Identification of putative toxin genes via homology and/or other computational analyses
- Sequence finishing of the gene of interest by one of several PCR or cloning strategies (e.g. TAIL-PCR).

Example 2

Discovery of Novel Pesticidal Genes from *Bacillus thuringiensis* Having Homology to cry8

TABLE 1

| | | cry8 homologues | | | |
|---|---|---|---|---|---|
| Gene name | Strain | Molecular weight (kD) | Closest homolog | Nucleotide SEQ ID NO | Amino acid SEQ ID NO |
| Axmi128 | ATX13034 | 137.6 | 49% Cry8Bb1 | 1 | 50 |
| Axmi141 | ATX12996 | 139.1 | 50% Cry8Bc1 | 2 | 51 |
| Axmi146 | ATX12996 | 136.5 | 46% Cry8Bb1 | 3 | 52 |

Example 3

Discovery of Novel Cry7-Like Pesticidal Genes from *Bacillus thuringiensis*

Novel pesticidal genes were identified from the bacterial strains listed in Table 2 using the methods disclosed in Example 1.

TABLE 2

| | | cry7-like sequences | | | |
|---|---|---|---|---|---|
| Gene name | Strain | Molecular weight (kD) | Closest homolog | Nucleotide SEQ ID NO | Amino acid SEQ ID NO |
| Axmi152 | ATX13006 | 128.4 | 67% Cry7Aa1 | 4 | 53 |

Example 4

Discovery of a Novel cry1I Homolog from *Bacillus thuringiensis*

A novel pesticidal gene was identified from the bacterial strain listed in Table 3 using the methods disclosed in Example 1.

TABLE 3

| | | cry1I homolog | | | |
|---|---|---|---|---|---|
| Gene name | Strain | Molecular weight (kD) | Closest homolog | Nucleotide SEQ ID NO | Amino acid SEQ ID NO |
| Axmi156 | ATX14775 | 84.8 | 95% Cry1Ie1 | 5 | 54 |

Example 5

Discovery of Novel Cry9 Homologues from *Bacillus thuringiensis*

Novel pesticidal genes were identified from the bacterial strains listed in Table 4 using the methods disclosed in Example 1.

TABLE 4 cry9 homologues

| Gene name | Strain | Molecular weight (kD) | Closest homolog | Nucleotide SEQ ID NO | Amino acid SEQ ID NO |
|---|---|---|---|---|---|
| Axmi162 | ATX14775 | 131.6 | 90% Cry9Db1 | 6 | 55 |

Example 6

Discovery of Novel Cry4 Homologues from *Bacillus thuringiensis*

Novel pesticidal genes were identified from the bacterial strains listed in Table 5 using the methods disclosed in Example 1.

TABLE 5 cry4 homologues

| Gene name | Strain | Molecular weight (kD) | Closest homolog | Nucleotide SEQ ID NO | Amino acid SEQ ID NO |
|---|---|---|---|---|---|
| Axmi131 | ATX13029 | 78.9 | 58% Cry4Ba1 | 7 | 56 |
| Axmi139 | ATX13027 | 68.5 | 38% Cry4Ba1 57% Axmi081 | 8 | 57 |
| Axmi144 | ATX15076 | 71.7 | 34% Cry29Aa1 | 9 | 58 |
| Axmi145 | ATX15076 | 64.6 | 64% Cry4Aa1 | 10 | 59 |
| Axmi167 | ATX15076 | 139.7 | 46% Cry4Aa2 | 11 | 60 |
| Axmi140 | ATX13027 | 161.9 | 31% Cry4Ba2 61% Axmi075 | 12 | 61 |

Example 7

Discovery of Novel cryC53/cryC53-Like Sequences from *Bacillus thuringiensis*

Novel pesticidal genes were identified from the bacterial strains listed in Table 6 using the methods disclosed in Example 1. The full length sequence encoding both axmi-153 and axmi-154 is set forth in SEQ ID NO:48. The full length sequence encoding both axmi-157 and axmi-158 is set forth in SEQ ID NO:49.

TABLE 6 cryC35/53-like sequences

| Gene name | Strain | Molecular weight (kD) | Closest homolog | Nucleotide SEQ ID NO | Amino acid SEQ ID NO |
|---|---|---|---|---|---|
| Axmi153[1] | ATX13037 | 37.5 | 54% CryC35 94% Axmi063 | 13 | 62 |
| Axmi154[2] | ATX13037 | 39.3 | 44% CryC53 76% Axmi064 | 14 | 63 |
| Axmi157[3] | ATX13049 | 37.2 | 38% CryC35 46% Axmi033 | 15 | 64 |
| Axmi158[4] | ATX13049 | 36.2 | 31% CryC53 40% Axmi064 | 16 | 65 |

[1] pairs with Axmi154,
[2] pairs with Axmi153,
[3] pairs with Axmi158,
[4] pairs with Axmi157

Example 8

Discovery of Novel Cry21/Cry12-Like Sequences from *Bacillus thuringiensis*

Novel pesticidal genes were identified from the bacterial strains listed in Table 7 using the methods disclosed in Example 1.

TABLE 7 cry21/cry12-like sequences

| Gene name | Strain | Molecular weight (kD) | Closest homolog | Nucleotide SEQ ID NO | Amino acid SEQ ID NO |
|---|---|---|---|---|---|
| Axmi155 | ATX13020 | 146.4 | 37% Cry21Ba1 | 17 | 66 |
| Axmi169 | ATX13053 | 146.4 | 45% Cry21Ba1 | 18 | 67 |
| Axmi170 | ATX13053 | 146.4 | 52% Cry21Ba1 | 19 | 68 |
| Axmi171 | ATX24692 | 95.2 | 22% Cry12Aa2 | 204 | 205 |

Example 9

Discovery of Novel VIP-Like or Binary-Like Sequences from *Bacillus thuringiensis*

Novel pesticidal genes were identified from the bacterial strains listed in Table 8 using the methods disclosed in Example 1.

TABLE 8

VIP-like or binary-like sequences

| Gene name | Strain | Molecular weight (kD) | Closest homolog | Nucleotide SEQ ID NO | Amino acid SEQ ID NO |
|---|---|---|---|---|---|
| Axmi135 | ATX13015 | 98.0 | 71% Vip1Bb1 | 21 | 70 |
| Axmi136 | ATX13015 | 55.6 | 78% Vip2Ad1 | 22 | 71 |
| Axmi142 | ATX13038 | 41.4 | 24% BinA | 23 | 72 |
| Axmi149 | ATX13059 | 100.1 | 32% CdtB | 24 | 73 |

Example 10

Discovery of Novel MTX-Like Sequences from *Bacillus thuringiensis*

Novel pesticidal genes were identified from the bacterial strains listed in Table 9 using the methods disclosed in Example 1.

TABLE 9

MTX-like sequences

| Gene name | Strain | Molecular weight (kD) | Closest homolog | Nucleotide SEQ ID NO | Amino acid SEQ ID NO |
|---|---|---|---|---|---|
| Axmi130 | ATX13025 | 32.9 | 21% Mtx3 | 25 | 74 |
| Axmi177 | ATX25337 | 37.0 | 14% Mtx2 21% Axmi019 | 26 | 75 |
| Axmi178 | ATX25743 | 36.4 | 17% Mtx2 | 27 | 76 |
| Axmi179 | ATX25743 | 36.1 | 18% Mtx2 22% Axmi034 | 28 | 77 |
| Axmi180 | ATX26054 | 35.6 | 22% Mtx2 35% Axmi122 | 29 | 78 |

Example 11

Discovery of a Novel Toxin Sequence from *Bacillus thuringiensis*

A novel pesticidal gene was identified from the bacterial strain listed in Table 10 using the methods disclosed in Example 1.

TABLE 10

| Gene name | Strain | Molecular weight (kD) | Closest homolog | Nucleotide SEQ ID NO | Amino acid SEQ ID NO |
|---|---|---|---|---|---|
| Axmi133 | ATX13029 | 57.9 | 42% 1-phosphatidylinositol phosphodiesterase | 30 | 79 |

Example 12

Discovery of Novel Toxin Sequences from *Bacillus thuringiensis*

Novel pesticidal genes were identified from the bacterial strains listed in Table 11 using the methods disclosed in Example 1.

TABLE 11

| Cry homologues | | | | |
|---|---|---|---|---|
| Gene name | Strain | Molecular weight (kD) | Closest homolog | Nucleotide SEQ ID NO | Amino acid SEQ ID NO |
| Axmi143 | ATX13053 | 77.1 | 30% Cry28Aa2 | 31 | 80 |
| Axmi165 | ATX25337 | 144.9 | 54% Cry32Aa1 | 32 | 81 |
| Axmi166 | ATX25204 | 141.4 | 55% Cry32Aa1 | 33 | 82 |
| Axmi168 | ATX15076 | 77.5 | 38% Cry10Aa1 50% Axmi125 | 34 | 83 |
| Axmi172 | ATX24692 | 84.7 | 31% Cry2Aa1 | 35 | 84 |
| Axmi173 | ATX25337 | 170.4 | 55% Cry32Aa1 | 36 | 85 |
| Axmi174 | ATX25337 | 143.6 | 63% Cry32Ba1 | 37 | 86 |
| Axmi175 | ATX25337 | 146.0 | 54% Cry32Ca1 60% Axmi057 | 38 | 87 |
| Axmi176 | ATX25337 | 143.5 | 54% Cry32Aa1 | 39 | 88 |
| Axmi148 | ATX13059 | 90.2 | 25% Cry31Aa1 | 40 | 89 |
| Axmi181 | ATX12978 | 65.4 | 12% Cry19Ba1 21% Axmi018 | 41 | 90 |
| Axmi182 | ATX12978 | 59.0 | 13% Cry17Aa1 | 42 | 91 |

Example 13

Discovery of Novel Toxin Sequences from *Bacillus thuringiensis*

Novel pesticidal genes were identified from the bacterial strains listed in Table 12 using the methods disclosed in Example 1.

TABLE 12

| Cry homologues | | | | |
|---|---|---|---|---|
| Gene Name | Strain | Molecular weight (kD) | Closest Homolog | Nucleotide SEQ ID NO | Amino acid SEQ ID NO |
| Axmi185 | ATX13053 | 39.2 | 24% Cry55Aa1 | 43 | 92 |
| Axmi186 | ATX13053 | 39.9 | 21% Cry55Aa | 44 | 93 |

Example 14

Discovery of Novel Toxin Sequences from *Bacillus thuringiensis*

Novel pesticidal genes were identified from the bacterial strains listed in Table 13 using the methods disclosed in Example 1.

TABLE 13

Cry homologues

| Gene Name | Strain | Molecular weight (kD) | Closest Homolog | Nucleotide SEQ ID NO | Amino acid SEQ ID NO |
|---|---|---|---|---|---|
| Axmi187 | ATX12973 | 36.3 | 33% Cry15Aa1 (Bti) | 45 | 94 |
| Axmi188 | ATX12973 | 34.9 | 34% Cry15Aa1 (Bti) | 46 | 95 |
| Axmi189 | ATX12973 | 35.4 | 36% Cry15Aa1 (Bti) | 47 | 96 |

Example 15

Expression in *Bacillus*

The toxin gene disclosed herein is amplified by PCR from pAX980, and the PCR product is cloned into the *Bacillus* expression vector pAX916, or another suitable vector, by methods well known in the art. The resulting *Bacillus* strain, containing the vector with axmi gene is cultured on a conventional growth media, such as CYS media (10 g/l Bacto-casitone; 3 g/l yeast extract; 6 g/l $KH_2PO_4$; 14 g/l $K_2HPO_4$; 0.5 mM $MgSO_4$; 0.05 mM $MnCl_2$; 0.05 mM $FeSO_4$), until sporulation is evident by microscopic examination. Samples are prepared and tested for activity in bioassays.

Example 16

Construction of Synthetic Sequences

In one aspect of the invention, synthetic toxin sequences were generated. These synthetic sequences have an altered DNA sequence relative to the parent toxin sequence, and encode a protein that is collinear with the parent toxin protein to which it corresponds, but lacks the C-terminal "crystal domain" present in many delta-endotoxin proteins. Synthetic sequences corresponding to the novel toxins disclosed herein are set forth in Table 14.

TABLE 14

Synthetic nucleotide sequences encoding toxins

| Wild-type Gene Name | Synthetic Gene Name | SEQ ID NO: |
|---|---|---|
| Axmi128 | Axmi128bv01 | 97 |
|  | Axmi128bv02 | 98 |
| Axmi130 | Axmi130bv01 | 99 |
|  | Axmi130bv02 | 100 |
| Axmi131 | Axmi131bv01 | 101 |
|  | Axmi131bv02 | 102 |
| Axmi133 | Axmi133bv01 | 103 |
|  | Axmi133bv02 | 104 |
| Axmi140 | Axmi140bv01 | 105 |
|  | Axmi140bv02 | 106 |
| Axmi141 | Axmi141bv01 | 107 |
|  | Axmi141bv02 | 108 |
| Axmi142 | Axmi142bv01 | 109 |
|  | Axmi142bv02 | 110 |
| Axmi143 | Axmi143bv01 | 111 |
|  | Axmi143bv02 | 112 |
| Axmi144 | Axmi144bv01 | 113 |
|  | Axmi144bv02 | 114 |
| Axmi146 | Axmi146bv01 | 115 |
|  | Axmi146bv02 | 116 |
| Axmi148 | Axmi148_1bv01 | 117 |
|  | Axmi148_1bv02 | 118 |
|  | Axmi148_2bv01 | 119 |
|  | Axmi148_2bv02 | 120 |
| Axmi149 | Axmi149bv01 | 121 |
|  | Axmi149bv02 | 122 |
| Axmi152 | Axmi152bv01 | 123 |
|  | Axmi152bv02 | 124 |
| Axmi153 | Axmi153bv01 | 125 |
|  | Axmi153bv02 | 126 |
| Axmi154 | Axmi154bv01 | 127 |
|  | Axmi154bv02 | 128 |
| Axmi155 | Axmi155bv01 | 129 |
|  | Axmi155bv02 | 130 |
| Axmi156 | Axmi156_1bv01 | 131 |
|  | Axmi156_1bv02 | 132 |
|  | Axmi156_2bv01 | 133 |
|  | Axmi156_2bv02 | 134 |
|  | Axmi156v03.04 | 197 |
|  | Axmi156v03.03 | 198 |
| Axmi157 | Axmi157bv01 | 135 |
|  | Axmi157bv02 | 136 |
|  | Axmi157v01.02 | 199 |
|  | Axmi157v01.03 | 200 |
|  | Axmi157v01.04 | 201 |
| Axmi158 | Axmi158bv01 | 137 |
|  | Axmi158bv02 | 138 |
| Axmi162 | Axmi162bv01 | 139 |
|  | Axmi162bv02 | 140 |
| Axmi165 | Axmi165_1bv01 | 141 |
|  | Axmi165_1bv02 | 142 |
|  | Axmi165_2bv01 | 143 |
|  | Axmi165_2bv02 | 144 |
| Axmi166 | Axmi166bv01 | 145 |
|  | Axmi166bv02 | 146 |
| Axmi167 | Axmi167bv01 | 147 |
|  | Axmi167bv02 | 148 |
| Axmi168 | Axmi168bv01 | 149 |
|  | Axmi168bv02 | 150 |
| Axmi169 | Axmi169bv01 | 151 |
|  | Axmi169bv02 | 152 |
| Axmi170 | Axmi170bv01 | 153 |

TABLE 14-continued

Synthetic nucleotide sequences encoding toxins

| Wild-type Gene Name | Synthetic Gene Name | SEQ ID NO: |
|---|---|---|
|  | Axmi170bv02 | 154 |
| Axmi171 | Axmi171_1bv01 | 155 |
|  | Axmi171_1bv02 | 156 |
|  | Axmi171_2bv01 | 157 |
|  | Axmi171_2bv02 | 158 |
|  | Axmi171v02.03 | 202 |
|  | Axmi171v02.04 | 203 |
| Axmi172 | Axmi172_1bv01 | 159 |
|  | Axmi172_1bv02 | 160 |
|  | Axmi172_2bv01 | 161 |
|  | Axmi172_2bv02 | 162 |
| Axmi173 | Axmi173_1bv01 | 163 |
|  | Axmi173_1bv02 | 164 |
|  | Axmi173_2bv01 | 165 |
|  | Axmi173_2bv02 | 166 |
| Axmi174 | Axmi174bv01 | 167 |
|  | Axmi174bv02 | 168 |
| Axmi175 | Axmi175bv01 | 169 |
|  | Axmi175bv02 | 170 |
| Axmi176 | Axmi176_1bv01 | 171 |
|  | Axmi176_1bv02 | 172 |
|  | Axmi176_2bv01 | 173 |
|  | Axmi176_2bv02 | 174 |
| Axmi177 | Axmi177bv01 | 175 |
|  | Axmi177bv02 | 176 |
| Axmi178 | Axmi178bv01 | 177 |
|  | Axmi178bv02 | 178 |
| Axmi179 | Axmi179bv01 | 179 |
|  | Axmi179bv02 | 180 |
| Axmi180 | Axmi180bv01 | 181 |
|  | Axmi180bv02 | 182 |
| Axmi181 | Axmi181bv01 | 183 |
|  | Axmi181bv02 | 184 |
| Axmi182 | Axmi182bv01 | 185 |
|  | Axmi182bv02 | 186 |
| Axmi185 | Axmi185bv01 | 187 |
|  | Axmi185bv02 | 188 |
| Axmi186 | Axmi186bv01 | 189 |
|  | Axmi186bv02 | 190 |
| Axmi187 | Axmi187bv01 | 191 |
|  | Axmi187bv02 | 192 |
| Axmi188 | Axmi188bv01 | 193 |
|  | Axmi188bv02 | 194 |
| Axmi189 | Axmi189bv01 | 195 |
|  | Axmi189bv02 | 196 |

In another aspect of the invention, modified versions of synthetic genes are designed such that the resulting peptide is targeted to a plant organelle, such as the endoplasmic reticulum or the apoplast. Peptide sequences known to result in targeting of fusion proteins to plant organelles are known in the art. For example, the N-terminal region of the acid phosphatase gene from the White Lupin *Lupinus albus* (Genebank ID GI:14276838; Miller et al. (2001) Plant Physiology 127: 594-606) is known in the art to result in endoplasmic reticulum targeting of heterologous proteins. If the resulting fusion protein also contains an endoplasmic retention sequence comprising the peptide N-terminus-lysine-aspartic acid-glutamic acid-leucine (i.e. the "KDEL" motif (SEQ ID NO:208) at the C-terminus, the fusion protein will be targeted to the endoplasmic reticulum. If the fusion protein lacks an endoplasmic reticulum targeting sequence at the C-terminus, the protein will be targeted to the endoplasmic reticulum, but will ultimately be sequestered in the apoplast.

Example 17

Bioassay of Axmi156

Gene Expression and Purification

The DNA regions encoding the toxin domain of Axmi156 was separately cloned into an *E. coli* expression vector pMAL-C4x behind the malE gene coding for Maltose binding protein (MBP). These in-frame fusions resulted in MBP-Axmi fusion proteins expression in *E. coli*. For expression in *E. coli*, BL21*DE3 was transformed with individual plasmids. A single colony was inoculated in LB supplemented with carbenicillin and glucose, and grown overnight at 37° C. The following day, fresh medium was inoculated with 1% of overnight culture and grown at 37° C. to logarithmic phase. Subsequently, cultures were induced with 0.3 mM IPTG for overnight at 20° C. Each cell pellet was suspended in 20 mM Tris-Cl buffer, pH 7.4+200 mM NaC1+1 mM DTT+ protease inhibitors and sonicated. Analysis by SDS-PAGE confirmed expression of fusion protein.

Total cell free extracts were run over amylose column attached to FPLC for affinity purification of MBP-axmi fusion protein. Bound fusion protein was eluted from the resin with 10 mM maltose solution. Purified fusion protein was then cleaved with either Factor Xa or trypsin to remove the amino terminal MBP tag from the Axmi protein. Cleavage and solubility of the proteins was determined by SDS-PAGE.

Insect Bioassays

Cleaved proteins were tested in insect assays with appropriate controls. A 5-day read of the plates showed that the fusion protein cleaved with Factor Xa and trypsin had pesticidal activity against Diamondback moth and Southwestern cornborer pests.

Example 18

Activity of Axmi-171 on the Hemipteran *Lygus hesperus*

To test the ability of Axmi-171 to control plant pest species, the open reading frame was cloned into a vector designed to yield high levels of soluble protein by creating an N-terminal fusion between a protein of interest and a highly expressed, highly soluble protein. Axmi-171 was cloned into the expression vector pMal-C4x (New England Biolabs), as two different constructs. The first construct (amxi-171.1, corresponding to SEQ ID NO:204, which encodes SEQ ID NO:205) did not yield high levels of expression and was not further pursued. Expression of the open reading frame constituting the internal methionine initiation codon (corresponding to SEQ ID NO:20, which encodes SEQ ID NO:69), yielded a construct designated pAX5557, whereby the shorter open reading frame was fused in-frame to the maltose binding protein. The nucleotide sequence of the construct is set forth in SEQ ID NO:206, and the encoded fusion protein is set forth in SEQ ID NO:207. Using this construct, expression of Axmil71.2 was induced as per manufacturer's instructions, and the fusion protein purified as known in the art.

Purified fusion protein was treated with a protease (Factor Xa, as known in the art) to cleave the fusion and liberate Axmil71.2. Interestingly, Axmil71.2 was found to precipitate after this cleavage reaction. Precipitated protein was formed into a suspension in water, and tested in a bioassay on *Lygus hesperus*. Activity against *Lygus heperus* was observed, as shown in Table 15.

TABLE 15

Activity of resuspended Axmi 171.2 on *Lygus hesperus*

| Sample | Mortality (%) |
|---|---|
| Axmi 171.2 Xa cut pellet, resuspended in water, 500 ppm | 99 ± 2.5 |
| Axmi 171.2 Xa cut pellet, resuspended in water, 200 ppm | 98 ± 2.5 |
| Axmi 171.2 Xa cut pellet, resuspended in water, 100 ppm | 88 ± 5 |
| Axmi 171.2 Xa cut pellet, resuspended in water, 50 ppm | 80 ± 5 |
| Water only control | 0 |

Example 19

Activity of Axmi 171 on the Hemipteran Soybean Aphid (*Aphis glycines*)

To further test the ability of Axmi171 to control pests, cleaved pmal-Axmi-171.2 protein was tested in a bioassay on the soybean aphid (*Aphis glycines*), in a multi-container format. Multiple containers were prepared containing either re-suspended Axmi171.2 protein (cleaved with Factor Xa as above), re-suspended 171.2 protein that had subsequently been heated (100° C. for 30 minutes), or water control. Multiple animals were exposed to the sample in each container, and at the end of the assay the number of containers with 100% mortality in each container was recorded. A score of zero was recorded for samples where none of the containers showed 100% mortality. A score of "1" was recorded for samples where 0-25% of the containers showed 100% mortality, a score of "2" was recorded for samples where 25-50% of the containers had 100% mortality, a score of "3" was recorded where 50-75% of the containers showed 100% mortality, and a score of "4" was recorded for samples where 100% of the containers showed 100% mortality. Activity on this pest was observed compared to water only controls, as well as samples that had been heated prior to inclusion in the sample.

Subsequently the Axmi171.2 open reading frame was cloned into a His-tag expression vector (pRSF-1b; Novagen), and protein expressed and purified by virtue of the His tag (as known in the art) resulting in clone pAX5068. Soluble, purified Axmi171.2 protein was obtained. One sample was heated to 100° C. for 30 minutes before being bioassayed. Assay of *Aphis glycines* in a multiple container format showed activity of the Axmi171.2 samples compared to controls.

Additionally, an *E. coli* expression clone expressing AXMI 171.2 protein lacking an N-terminal tag or fusion was prepared, and denoted as pAX5069. A concentrated extract containing soluble Axmi171.2 protein was prepared and similarly assayed for activity on *Aphis glycines*.

TABLE 16

Activity of resuspended Axmi 171.2 on *Aphis glycines*

| Sample | Average Mortality Score |
|---|---|
| Test 1: pAX5557 (purified pMal fusion) | |
| Axmi-171.2 Fusion, Factor Xa cut; resuspended in water | 2 |
| Axmi-171.2 Fusion, Factor Xa cut; resuspended in water and heated | 0 |
| Water control | 0 |
| Test 2: pAX5068 (purified His Tagged Protein) | |
| His-tagged, purified AXMI-171.2 | 1 |
| His-tagged, purified and heat-treated AXMI-171.2 | 0 |
| Buffer (50 mM Tris (8.0) + 100 mM NaCl) | 0 |
| Test 3: pAX5069 (concentrated crude extract; no His Tag) | |
| Untagged AXMI-171.2, concentrated extract | 2 |
| 50 mM Tris (8.0) + 100 mM NaCl | 0 |

Example 20

Additional Assays for Pesticidal Activity

The ability of a pesticidal protein to act as a pesticide upon a pest is often assessed in a number of ways. One way well known in the art is to perform a feeding assay. In such a feeding assay, one exposes the pest to a sample containing either compounds to be tested, or control samples. Often this is performed by placing the material to be tested, or a suitable dilution of such material, onto a material that the pest will ingest, such as an artificial diet. The material to be tested may be composed of a liquid, solid, or slurry. The material to be tested may be placed upon the surface and then allowed to dry. Alternatively, the material to be tested may be mixed with a molten artificial diet, then dispensed into the assay chamber. The assay chamber may be, for example, a cup, a dish, or a well of a microtiter plate.

Assays for sucking pests (for example aphids) may involve separating the test material from the insect by a partition, ideally a portion that can be pierced by the sucking mouth parts of the sucking insect, to allow ingestion of the test material. Often the test material is mixed with a feeding stimulant, such as sucrose, to promote ingestion of the test compound.

Other types of assays can include microinjection of the test material into the mouth, or gut of the pest, as well as development of transgenic plants, followed by test of the ability of the pest to feed upon the transgenic plant. Plant testing may involve isolation of the plant parts normally consumed, for example, small cages attached to a leaf, or isolation of entire plants in cages containing insects.

Other methods and approaches to assay pests are known in the art, and can be found, for example in Robertson, J. L. & H. K. Preisler. 1992. *Pesticide bioassays with arthropods*. CRC, Boca Raton, Fla. Alternatively, assays are commonly described in the journals "Arthropod Management Tests" and "Journal of Economic Entomology" or by discussion with members of the Entomological Society of America (ESA).

Example 21

Vectoring of the Toxin Genes of the Invention for Plant Expression

Each of the coding regions of the genes of the invention is connected independently with appropriate promoter and terminator sequences for expression in plants. Such sequences are well known in the art and may include the rice actin promoter or maize ubiquitin promoter for expression in monocots, the *Arabidopsis* UBQ3 promoter or CaMV 35S promoter for expression in dicots, and the nos or PinII terminators. Techniques for producing and confirming promoter—gene—terminator constructs also are well known in the art.

Example 22

Transformation of the Genes of the Invention into Plant Cells by *Agrobacterium*-Mediated Transformation Ears are collected 8-12 days after pollination. Embryos are isolated from the ears, and those embryos 0.8-1.5 mm in size are used for transformation. Embryos are plated scutellum side-up on a suitable incubation media, and incubated overnight at 25° C. in the dark. However, it is not necessary per se to incubate the embryos overnight. Embryos are contacted with an *Agrobacterium* strain containing the appropriate vectors for Ti plasmid mediated transfer for 5-10 min, and then plated onto co-cultivation media for 3 days (25° C. in the dark). After co-cultivation, explants are transferred to recovery period media for five days (at 25° C. in the dark). Explants are incubated in selection media for up to eight weeks, depending on the nature and characteristics of the particular selection utilized. After the selection period, the resulting callus is transferred to embryo maturation media, until the formation of mature somatic embryos is observed. The resulting mature somatic embryos are then placed under low light, and the process of regeneration is initiated as known in the art. The resulting shoots are allowed to root on rooting media, and the resulting plants are transferred to nursery pots and propagated as transgenic plants.

Example 23

Transformation of Maize Cells with the Toxin Genes of the Invention

Maize ears are collected 8-12 days after pollination. Embryos are isolated from the ears, and those embryos 0.8-1.5 mm in size are used for transformation. Embryos are plated scutellum side-up on a suitable incubation media, such as DN62A5S media (3.98 g/L N6 Salts; 1 mL/L (of 1000× Stock) N6 Vitamins; 800 mg/L L-Asparagine; 100 mg/L Myo-inositol; 1.4 g/L L-Proline; 100 mg/L Casaminoacids; 50 g/L sucrose; 1 mL/L (of 1 mg/mL Stock) 2,4-D), and incubated overnight at 25° C. in the dark.

The resulting explants are transferred to mesh squares (30-40 per plate), transferred onto osmotic media for 30-45 minutes, then transferred to a beaming plate (see, for example, PCT Publication No. WO/0138514 and U.S. Pat. No. 5,240, 842).

DNA constructs designed to express the genes of the invention in plant cells are accelerated into plant tissue using an aerosol beam accelerator, using conditions essentially as described in PCT Publication No. WO/0138514. After beaming, embryos are incubated for 30 min on osmotic media, then placed onto incubation media overnight at 25° C. in the dark. To avoid unduly damaging beamed explants, they are incubated for at least 24 hours prior to transfer to recovery media. Embryos are then spread onto recovery period media, for 5 days, 25° C. in the dark, then transferred to a selection media. Explants are incubated in selection media for up to eight weeks, depending on the nature and characteristics of the particular selection utilized. After the selection period, the resulting callus is transferred to embryo maturation media, until the formation of mature somatic embryos is observed. The resulting mature somatic embryos are then placed under low light, and the process of regeneration is initiated by methods known in the art. The resulting shoots are allowed to root on rooting media, and the resulting plants are transferred to nursery pots and propagated as transgenic plants.

Materials

| DN62A5S Media | | |
|---|---|---|
| Components | per liter | Source |
| Chu'S N6 Basal Salt Mixture (Prod. No. C 416) | 3.98 g/L | Phytotechnology Labs |
| Chu's N6 Vitamin Solution (Prod. No. C 149) | 1 mL/L (of 1000× Stock) | Phytotechnology Labs |
| L-Asparagine | 800 mg/L | Phytotechnology Labs |
| Myo-inositol | 100 mg/L | Sigma |
| L-Proline | 1.4 g/L | Phytotechnology Labs |
| Casaminoacids | 100 mg/L | Fisher Scientific |
| Sucrose | 50 g/L | Phytotechnology Labs |
| 2,4-D (Prod. No. D-7299) | 1 mL/L (of 1 mg/mL Stock) | Sigma |

Adjust the pH of the solution to pH to 5.8 with 1N KOH/1N KCl, add Gelrite (Sigma) to 3 g/L, and autoclave. After cooling to 50° C., add 2 ml/L of a 5 mg/ml stock solution of Silver Nitrate (Phytotechnology Labs). Recipe yields about 20 plates.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (208 sequences)

SEQ ID NO: 1 - DNA, 3636 bp, Bacillus thuringiensis
gtgaaaaacgtttggaaagttattttatgtaataaatgtattggaggaaaaaggatgagcccaaataatcaaaatgagtttgatattatagatgtaccatctaatatttctgtatccaatagttttgttagatatcctttcgcaaatgatcccaatcgtacattacaaaatacaaattataaagattttttaacaatgtctgaaaaatctaattctggatatttaacagatcctgaagcttttgatgatgtcggttcagcgatttttgctggacttagtattactgctaaaatcatggatgctttcgatgttcctgggggagacatatttaatgggttacttgaaatcattggtatcctctgggatcttcaagatgacacatgggaagcttttatggaacaagtagaagtactgattgatcaaaaaatagcagagtatgcaagaaatcttgcacttacacatttaaaaggattagaaaatagttataaattatatttagaagcactagcagattggaaacaaaatcctactagtccaagttctcaagaacgtgtaagaacaaggttccgcgatactgatgattctttaacagtatttatgccatcttttgcagttaagggatatgaagttcctttattagcagtatatgcgcaagctgcgaatctgcatttattgttattgagagattccgttgcttatggattaggatgggggctttcccaacttaatgtgaatgataattataatcgacatgtacgactcacaggggaatatacaaatcattgtgtatcatggtatacaacgggtttagaaaaattaagaggttcgaatgcccagagttggattaaatttaatcgttatcgtagggaaatgacagtgatggtactagatatagttgctttatttcctaattatgatgcgcgtaggtaccctcaagcaactactacagaactaaccagattaatttatacggatccacatggttatacaatttattcaccaacttctcaaacaaccataccgtggtatgagtacggccaatctttctcagaaatagaaaatgttgcaattcaggcgcctagactttttaggtgggcgcaagaaatgcagatttatacaaaatttgtaagacacgccccacaagaatctcattattgggcagcccataccttttcatttcatcatactagagataataccaaaaccacactaacatatggagatacttcaaatcctatatctgtgggtacagctgatctaagcgatttagatatatataaagtttcatcattggttgcatcgagttgggggtcaggagttagattacttgttactaaagctaaatttgaggttatttatacatttaaccaattatgggaatttaattatgaacctccaggcatatccaatttttttaatcaatggaaaaatactgacacagaattacctatccagatagtcgacccacctacttttggagaccctaatcagtatagtcatagggtagcttatatttcccacgctccaatacaaccatattcaggggcttttagaaattatgggttggttcctgtatttggatggtcgcatgtgagtgtggatagaaataatacactttatgcagacagaattactcaaattcctgcggtgaaagctgtacagttaagtggtgaaccatatccagttgtacgtggacctggatttactggaggagatatagcccgattacctaataatccaaacgtaggattattgtttaatagtaaagtagaatcaccttcagaaaataagagatatcgtgtacgaataaggtacgcttgtgcttctggagctcgagcaatttttggtggattatacttacctataacagtccaatttaaccaaaccatgtcgactactactcctacaagatatgaagattttcaatatgtagatgtaagtggcacttttatattaggaaatactaatgtaagtttttctttagtaccccaaagtgctaatcaaactaataatttatttattgataaaattgaatttattccagaaaatccagcacttgaagcagaaagcgatttagaggctgcaaagaaagcagtaaatgccttgtttacgaatagtaaagatactttacagataggtgtgacagactatcaaatcaatcaagctgcaaatttaattgaatgcgtatccgatgaggtatatccaaatgaaaagcgattgttatttgatgcagtaaaagaggcaaaacgacttagtacggcacgtaacttgcttgaagatacggattttcatacaataaatgggggaaatggatggacgggaagtacgggtattgaaattgtggaaggagatattctctttaaagatcgctcgcttcgacttccaagtgcgagagaaatagagagagaaacttatccaacatatatctatcaaaaaatagaggaatcacgattaaaaccaaatacaagatatagtttgagagggtttatcggaagtagccaagatttagagatatatgtccttcgtcatcaggcatatcgtgttattaaaaatgtttcagataatctgttaccaaatatgcgccctatcaacgcttgtggaggagttgaccgatgcagtcaacaaaaatatgtgaataattcattagaagtgaatagcggtttatcaaatggaattggagcggctgactctcatgagttttcaattcatgtggatacaggagaactgaattataatgaggatatgggtatttgggttgtatttaaaatcacaactacagatgggtacgcaacagtagggaatattgaattggtggaagtggaaacgttatccggagaagcattagaacgtgtgcaaagacaagaaaagcagtggcagggccaattggcgacaagacgtaaagaaacagaaacgagatacgggccagcaaaacaagctattgatcgtttattcgtagattttcaagatcaacaactatctcgtagtacagaaatctcagatttgacggaagcgcaaaatctagtacagtctattccttacgtatacaatgatatgttaccagaaatcccgggcatgaactataccagtgttacagagttaacaaacagacttcaacaagcatggaatttgtatgaccagagaaatagcatacaaaatggtgatttccgaaatgatgtaagtaattggaatgttacaactgaagtcaatattcaacaaatgaatgatacgtctgtccttgtgattccaaattgggattcgcaagtgtcacaacaaattaccgttcaaccaaatcgaagatatgtgttacgtgttaccgcaagaaaagaaggaaatggagatggctatgtaaccatccgtgatggagcaaaccatacagaaacgctgacatttaatacatgtgattatgatggaaatagtgtatataataatcaaccattaaatgcaaataataatgtatatactacaaaatcatcaaataccaatagctatcatacaaatggtgtgtatcatgaccaaactagctatgttacaaaaacaatggaatttactccgtatacggagcaagtctgggttgagatgagtgaaacagaaggagtattttatatagacagtgtagaattgattgtagaagaaatg

SEQ ID NO: 2 - DNA, 3678 bp, Bacillus thuringiensis
gtgaaaaacgtttggaaagttattttatgtagtaaatgtattggaggaaaaaagatgagcccaaataatcaaaatgagtttgatattatagatgtaccatctaatacgtccatatctaccaattttgtcagatatcctttcgtaaacgatcccaatagtaatacattacaaaataaaaactataaagattttttaacaatgtctgaaaaatctaattctggatatttaacagatcctgaagcttttgatgatgtcggttccgcgatttttgctggacttagtattactgctaaaatcatggatgctttcgatgttcctggaggagacatatttaatgggttacttgaaatcattggtatcctctgggatcttcaagatgatacatgggaagcttttatggaacaagtagaagtactgattgatcaaaaaatagcagagtatgcaagaaatcttgcacttacaaatttaaaaggattagaaaatagttataaattatatttagaagcactagcagattggaaacaaaatcctactagtccaagttctcaagaacgtgtaagaacaaggttccgcgatactgatgattctttaacagtatttatgccatcttttgcagttaagggatatgaaattcctttattagcagtatatgcacaagctgcgaatctgcatttattgttattaagagattctgctgcttatggattaggatggggactttcccaacttaatgtgaatgataattataatcgacaagtacgactcacaggggaatatacaaatcattgtgtatcatggtatacaactggtttagaaaaattaagaggttcgaatgctcagagttggattaaatttaatcgttatcgtagggaaatgacagtgatggtactagatatagttgctttatttcctaattatgatgcgcgtagataccctcaagcaacgactacagaactaaccagattaatttatacggatccacatggttatacaatttattcaccaacttctcaaacaaccataccgtggtatgagtacggccaatctttctcagaaatagaaaatgttgcaattcaggcacctagactttttaggtgggcgcaaaaactccagatttactcaaaatttgtaaggcacgctccacaagaatctcattattggtcaggtcatacctttacatttcaccatactagagatgataccaaaacttcgctgacatatggagatattatagactacaaatatttgtctgaagctgatttaagcaatactgatatatataaagtttcatcattggttgcatcgagttgggggtcaggagttagattactcgttacaaaagctatatttgaaacaataaatacgagtaataaattaatagattatgaatatgatcttcaacttttgtctaattttttcaatgaatggaaaaataccgaagcagaactacctatccagatagtcaatccacctatttttggagacttcaatcagtatagccatagggtagcttatatttcccacgctccaatacaaccatattcaggggcttttagaaattatggattggttcctgtatatggatggtcacatgtgagtgtggatagaaataatacaatttatgcagacagaatttctcaaatccctgcggtgaaagctgtacagggaagtggtgaaccatatccagttgtacgtggacctgggtttactggaggagatatagcccgattacccaataatccaaacgtaggattatggtttaatagtaaagtagaatcaactgcattaaataagagatttcgtgtacgaataaggtacgcttgtgctactggagctcgagcagattttggtggattaaccctacctataacagtccaatttaaccaaaccatgtcgactactactcctacaagatatgaagattttcaatatgtagatataagtggctcttttttattaacaaataccaattcagggttttccttggtagcccaaagtgctaatcaaactaataatttgtttattgacaaaattgaatttattccagaaaacccagcacttgaagcagaaagtgatttagaggctgctaagaaagcagtgaatgccttgtttacgaatagaaaaaatgtcttacagacaggtgtgacagactatcaaattaatcaagctgcaaatttaattgaatgcgtatccgatgaggtatatccaaatgaaaagcgattgttatttgatgcagtaaaagaggcaaaacgacttagtgcaacacgtaacttgcttgaagatacggattttcatgcaataaatgggggaaatggatggacgggaagtacgggtattgaaattgtggaaggggatattctctttaaagatcgctcgcttagacttccaagtgcgagagaaacggatagagaaatttatccaacatatatatatcaaaaaatagatgaatcacgattaaaacaaaatacaagatatagcttaagaggctttatcggaagtagccaagatttagagatatatgtccttcgtcatcaggcatatcgtgttattaaaaatgtttcagataatctcctaccaaatatacgccctatcaacgcttgcggaggagttgaccgatgcagtcaacaaaaatatgtgaataattcattagaagtgaatagtggtttatcaaatggaattggagcgtctgattctcatgaattttcaattcatgtagatacaggggaactgaattacaacgagaatacgggtatttgggtggtatttaaaatcgcgacaacgaacggatacgcgacacttggaaatcttgaattggtagaagagggaccattatcgggagacgcattagaacgtgtaaaaaatcaagaaaagcagtggcaggaccaaatgacaagaagacgtgcggaaacagaaaatagatatggtttagccaaacaagctgttgatcgtttatttgtagactatcaggatcaacaagtatctcctattatagaaatatcagatttgactgcggcgcaaaatgtagttcagtccattccatatgtatataatgatatgttaccagaaatcccaggcatgaactataccagtgttacagagttaaccaatagacttcaacaagcatgggatttgtatgatcagagaaatagcatacaaaatggtgatttccgaaatgatgtaagtaattggaatgttacacctgaagtcaatattcaacaaatgaatgatacgtctgtccttgtgattccaaattgggattctcaagcgtcacaacaaattaccgttcaaccaaatcgaagatatgtgttacgtgttaccgcaagaaaagaaggaagcggagatggctatgtaaccatccgtgatggagcaaaatatacagaaacgctgacatttaatacatgtgattataatggaagtagtgtatatcaggagcaagcattgtatacaaatgatgtatacaatacgcaatccgctaacatacatggttcgaatagtgcgtatcatacacaagcatccaataccgatagatataatatgaatggtatgtataatgaccaaactagctatgttacaaaaacagtagaatttattccaaatacggagcaagtctggattgagatgagcgaaaccgagggcgtattctatatagagagtgtagaattgattgtagaagaaaat

SEQ ID NO: 3 - DNA, 3588 bp, Bacillus thuringiensis
atgagtccaaataatcaaaatgaatatgaaattatagatacaccatctagcaattctctagacaaccaatttgttagatacccattagcaaaagagcctactcaagtgagacaaaatttgaattataaagattggcttaattcattagatgagaataacaatcaaagttttggagtaactccgagaagagcctcagtagttggcgctgttggatcaattttaggggctacccttgggacaatcccgtatgtaggagatattttagcgctaattgtggggatattttggcctgaaggtagtgatccagaggattattctgaacttattaatgctataatggagcaagtagagctactcatagatcaaaaaataagcgagcaagttagaaatgatgcattggccaccttggaaagtagtgggatagctttacaagcatacttaaatgcattagaagattggaaaataaatcccaataatgcaagaagtacacagttagtaagagaaaggtttacctttgcagaagctcaagtacgtactaacatagcctatgtttcaagaaaagattatgagatcctgctcctgccaatatatgcacaagttgcaaacattcatttgttactattaaagcaagttcaactttatggaacaaaattgggttatactcaaaacgacattgatttaatttacgaagagcaaaagaagttcacagcacaatatacgaatcactgcactaattggtataatataggattgaataatatatgggagagtatagctggcacgtcttatagtggaagtcgttgggatgaatttaatgatttccgtcgcgatctgacattaaccgtattagatattgtttctacttttccaattcatgatacacgtttatatccagagaaagttaacggacaattaacaagggaaatttatactcgatcaattaatgtaaattactttaaccaagtatctgcaagaacaattgaagatgcagaaaggttacttacaaacccaccaaggcttttgccgtggatagaacaattggagtttaatactaatgtaaacttcagtgtcaattggaaatttttgacatctactagacgtagatttatttatactaacagtagcgacctcaattatgacggatatgcaggatatcatcttgatggtacgtccaattcttttttatacccttcaaataatgaaaggatatatacaattactgcacaacgttttggagaacaacgcaatattccgcaagctatcactggtttgacgtttagtatgaatactggcagaacatatagatattcatcgaatacacctgctggaccttcaataattactgaagattaccatttaccaggattaaacggtgaagaagttccaaactctaataattttagtcactttttgaggagtataaatggttattctaatggtaatcaaaggatatttcattcatttggttggacacatgctagtgtagattttgaaaataaaatttacccgactattattactcaaattccagcagttaaggcaatacaaggaactatgccatatccggttgtaaaagggcctggatttactgggggagatatagctcgattacctaataatcctaccttaggattatggtttaatggtactatggagtccctaggttcggggcatgatccagcaccaagatatcgtgtgagaattcgctatgcatctcaatcaggaggaagtgctaattttagatttatgagttcaaatggacagaattctagtcaacaaaacttttcttttacatcaacaatgacaactggtgaaccttcaaaatacgaggattttcgattttcagtattacctaatatagtaaccccgctaagtttcaatgtaagttggcacttagtagctagtaatgctaatccaaataacaatgtatatattgacagaattgaatttatcccagaatttttaatggcaagatcggatttagaaactgcaaagaaagcagtgaatgaattgtttactaatacaaaaaattctttacgaagagaggtcacggattatcaggtaagtcaagctgtaagcttagtagaatgtttatcagatgaattatatccaaatgaaaaacggatgctaattgatgcagtaaaagaagcgaaaagactcagtgaggcacgtaacttgcttgaagatatagatttgaaagtaataagtgagtacggggaagatggttggattggcagtaaggggattgaggttgcaaaaagtaatcctctttataaaaacgatcttcttcgtttaccaaaagtaagggaaattgaaggcgaaatatatccaacctatttatattataaagtagatgaatccttgctcaaaccatataccagatataaatttagaggatttattgaaagcagtcgagatttagagatatttgtcatccgtcatcaggcatatcgagttgttaaaaatgttccaagtaatcttttatccgatataggtcctgttaacgcttgtggaggattcgaccgatgtagcgaacaaaagtatgtaaatagtatgttagaattagataatgatttatcaaatgaaaatagatcatctgaagcacacgagttttctattcatgtagatacaggagaactcaattatagtgaaaatccaggtatttgggttgcatttaaaataacaaaaatggatggatatgctacagtaggaaatcttgaattggtagaagtggaaacgttatccggagaagcattagaacgtgtgcaaagacaagaaaagcagtggcagggccaattggcgacaagacgtaaagaaacagaaacgagatacgggccagcaaaacaagccattgatcgtttatttgtagactatcaggatcgacaattatattctggtacaaagatctctgatttaattgcagcccaaaatttagtgcagtccattccatacgtatataacgatatgttaccagaaatcccaggcatgaactataccagtgttacagagttaaccaatagacttcaacaagcatggaatttatatgaccagagaaatagtatacaaaatggtgatttccgaaaagatataaataattggaatgtcacaaatggagtcaatattcaacaaatgaatgatacgtctgttcttgtgattccaaattgggattcgcaagtgtcacaacaaattaccgttcaaccaaatcgaagatatgtgttacgtgttaccgcaagaaaagaaggaagcggagatggctatgtaacgatccgtgatggagcaaaatatacagaaacgctgacatttaatacatgtgattataatggaagtaatgtatatcaggagcaagcattgtatacaaatgatgtatacaatacgcaatccgctaacatacatggttcgaatagtgcgtatcatacacaagcatccaataccgatagatataatatgaatggtatgtataatgaccaaactagctatgttacaaaaacagtagaatttattccaaatacggagcaagtctggattgagatgagcgaaaccgagggcgtattctatatagagagtgtagaattgattgtagaagaaaat

SEQ ID NO: 4 - DNA, 3402 bp, Bacillus thuringiensis
atgatggacgtaaataaattttatggaagtagaaatgttaatagaatgttaaacaatcctttcaataattctactcaaaaagaattattaccagtagtaactcaaaacccctgtgtagataatccgtttgttaataaaataaaccaaacagaaatgctcactaatactagtatagcgttaaacaccgtagctggtgttacaggagctgtattgggttcgttaggtgttccaggagcaagccttataacttctttttatcaaaaagttttagggcttttatggccaactaattcaagagccgaaatatgggattcgttcataagtgtagtagaagacttgattaagaaagaagtagaaaattacgcaagggaaaaagccattacagaattagagggactaggagacaatatgaaagattataaaagtaaacttcaacaatggcttgatacccctaatgatgacactaaaagaagcctaaaacattacatggaaagtctagatatggattttaaggagcacatgcctcagtttagaattaaagggtatgaagtacaattactacctgttttcgcacatgccgcaaaccttcatctaagtctatttagagatatggtcctttatggtcctgatttgggttttacaccggaagatctttcggaagattatcaacaactacaacaaagaataattgattatacgaatcattgcaatctttattttgaacaaggactttcttccttaaaaaaatcctcttatgaagagtgggtaatctataatcgttttcgtagagaaatgacattgatggtattagatattattgcacaattcccatattatgacgttaaaaaataccctaaaccggtcagtactcagttgacaagagaagtgtatactgatcctttaataacttcattttttcagccagggcaaggaccaaatttttctttcatggaaagtaacgcaattcgaaacccgcaccttgttacttatttagatagcctttatatatatacagcgaaatttagagcatactcacaggagattcaacctgacttatatttttggactgcacataaaggtaaatataaattatcggcaagtactgatgtacatgatacagctttatatggtagtacaagtggtagtataagtgaaaaaaactactcatttaatggtaataatatatatcaaacattagcagctccaagtgccgtattcacaacctcaaaacagtattatggtatagaacaagttgagttttatggtgataaaggaaagatccattattatggagatagaaaataccctttgtctgttgattctgctaatcaattaccaccagatgaagaaccaatatcagaaaattacgatcatattttaactcatgcttcagctgtaaacgtattagatggaggtacagttccaatctttgcttggacacatagaagtgcggattattacaatactatttattcagataagattacgcaaattccagctgtgaaaataaataaactagagaatccatctacagttgtcaaagggcctggatttacaggtggagatttagttaagagagggagtacggggattttgggatatcttaatgttacagtaaattccccgttatctcaaagatatgccgtgaaaattcgatatgcttcaacaattagtggagattttcacgtgcaaattgacggcgtagctaccctggaggggcattgtgaaagtactataaattcaggcgatgaattatcatttgaatcgtttagttataaagagttctcaaccactgttcaatttacaggaaacaaaccaagactaaggttatccttggataaggtagctggtacaggagttttttatttcgataaaatcgaatttatccctgtagatgtaaattatgatgaaagagttcaattagaaaaagcacagaaatccgtgaatgccttgtttacagcgggaagacatgcactccaaacagatgtgacagattttaaagtagatcaggtttccatattagtggattgtgtatcaggggagttatatcccaatgagaaacgcgaactactaagtttagtcaaatacgcaaaacgtttgagctattcccgtaatttactcttagatccaacattcgattctattaactcatcagaggagaatggctggcacggaagtaatggtattgtgattggcaatgggaactttgtattcaaaggaaactatttaattttctcaggtaccaatgatacacaatacccaacgtatctctatcaaaaaattgatgaatccaagctcaaagaatatacacgctataaactgagaggatttatcgagaatagtcaagatttagaagcatatgtggttcgctatgatgcaaaacatgaaacattggatgtatccgataatctatacccagatatttctcctgtaaatgcatgcggagaacccaatcgttgtgcggcactaccatacctggatgaaaatccgaggttagaatgtagttcgatacaagatggtattttatctgattcgcattcattttctctcaatatagatacaggttctattgattccaatgagaacgtaggcatttgggtgttgtttaaaatttccacaccagaagggtatgcgaaatttggaaacctagaagtgattgaagatggcccagtcattggagaagcgttagcccgtgtgaaacgtcaagaaacgaagtggagaaacaagttggcacaattgagaacggaaacacaagcgatttatacacgcgcaaaacaagccattgataatttattcacaaatgcacaggactctcacttaaaaataggtgctacattcgcgtcaattgtggctgcacgaaagattgtccaatccatacgtgaagcgtatatgtcatggttatctatcgtcccaggtgtaaattatcctatttttacagagttgaatgagagagtacagcaagcatttcaattatatgatgtacggaatgtcgtgcgtaatggccgattcctgaatggagtatcggattggattgtgacatctgatgtaaaggtacaagaagaaaatgggaacaatgtattagtcctttccaattgggatgcgcaagtattacaatgtctgaagctctatcaagatcgcggatatatcttgcgtgtaacggcacgtaaagaaggattgggagaaggatatattacaattacggatgaagcagggcatacagatcaattgacatttggcacatgtgaggaaatagatgcatctaacacgttcgtatctacaggttatatgacaaaagaactagaatttttcccagatacagagaaagtgcgtatagaaattggagaaacagagggaatattccaggtggaaagtgtagaattatttttgatggaagatctatgt

SEQ ID NO: 5 - DNA, 2244 bp, Bacillus thuringiensis
ttgacaccacagcaccttataaatttgtttgaacgaaattttatctgggaaaataataagataataagtgaagggattaatatgaaatcgaagaatcaagatatgaatcaaagattatcttacaatacaacagttgataaaaactctacggattcactaagaaatgaaacagatatagaattgaaaaatattaatcatgaggatttcctaagaatgtctgagcatgagagtattgatccatttgttagtgtttcaacaattcaaacggggattggtattgctggtaaaatacttggtaccctaggtgttccttttgctggacaaatagctagcctctatagttttatcttaggcgagctttggcctaaagggaaaagccaatgggaaatctttatggaacatgtagaagagcttattgaccaaaaaatatcaacttacgcaagaaatatagcacttgcagatttaaaaggattaggagatgctttggctgtctaccatgaatcgctggaaagttggattaaaaatcgcaacaacgcaagggctacaagtgtcgtcaagagccaatatatcgctttagaactattgtttgttcaaaagctgccttcttttgcagtatcaggtgaggaagtaccattattgccaatatatgcacaagctgcaaatttacacttgttattactaagagatgcttctgtttttggaaaagagtggggattatctaattcgcaaatttctacattttataatcgtcaagtcgaaagaacgagtgactattccgaccattgtgtgaaatggtacagtacaggtctaaataacttgaggggtacaaatgctgaaagctgggttcgttataatcaattccgtaaagatatgacattaatggtactagatttagtcgcactattcccaagttatgatacacttgtatatccaattaaaactacttctcaacttacaagagaagtatatacagacgcaattgggacagtacatccgaatgcaagttttgcaagtacgacctggtataataataataataatgtaccttcgttctccgtgatagaggctgctgttgttcgaaacccgcatctactcgattttctagaacaagttacaatttatagcttattaagtaggtggagtaacactcagtatatgaatatgtggggaggacatagacttgaattccgaacaataggaggagcgataaatacctcaacacaagggtctactaatacttctattaatcctgtaatattaccgttcacgtctcgagacgtctataggactgaatcattggcagggctgaatctatttttaactcaacctgttaatggagtacctagggttgattttcattggaaattcgccacacttccgattgcatctgataatttctattatccagggtatgctggaattgggacgcaattacaagattcagaaaatgaattaccacctgaaacaaaaggacagccaaattatgaatcatatagtcatagattatctcatataggacttatttcagcatcacatgtgaaagcattggtatattcttggacgcatcgtagtgcagaacgtacaaatacaattgagccaaatagcattacacaaatacctttagtaaaagcattcaatctgtcttcaggtgccgctgttgttaaaggaccaagatttacaggtggggatatcctccgaagaacgaatactggtacttttggggatatacgagttaacattaatccaccatttgcacaaaggtatcgcgtaaggattcgttatgcttctactacggatttacaattccacacgtcaattaacggaagagctattaatcaaggtaattttccagcaactatgaatagaggagaggacttagaatatagaacctttagaactgtaggctttactactccatttagcttttcagatatacaaagtacatttacaataggtgcttggaacttctcttcaggtaacgacgtttatatagatagaattgaatttgttccggtagaagtaacatatgaggcagagtatgattttgaaaaagcgcaagaggaggttactgcactgtttacatctacgaatccaaaagggttaaaaacagatgtaacggattatcatattgaccaggtatcaaatttagtagagtctctatcagatgaattctatctcgatgaaaagagagaattattcgagatagttaaatacgcaaggcaactcaatattgagcgtaacatg

SEQ ID NO: 6 - DNA, 3504 bp, Bacillus thuringiensis
atgaatcgaaataatcaaaatgaatatgaaattattgatgcccctcattgtggatgtccttcagatgatgttgtgaaatatcctttgacagatgatccgaatgctggattgcaaaatatgaactataaggaatatttacaaatgtatggtggggactatacagatcctcttattaatcctaacttatctgttagtggaaaagatgtaatacaagttggaattaatattgtagggagattactaagcttttttggatttcccttttctagtcaatgggttactgtatatacctatcttttaaacagcttgtggccggatgacgagaattctgtttgggatgcttttatgaagagagtagaagaacttattgatcaaaaaatctcagaagcagtaaagggtagagcgttggatgatctaactggattacaagagaattataatttatatgtagcagcattagatgagtggctgaatagaccgaatggcgcaagggcatccttagtttctcagcgatttaacattttagatagcttatttacacaatttatgccaagctttggctctggtcctggaagtcaaaattatgcaactatattacttccagtatatgcacaagcagcaaaccttcatttgttattattaaaagatgcagacatttatggagctagatgggggctgaatcaaactcaaatagatcaattccattctcgtcaacaaagccttactctgacttatacaaatcattgtgttactgcgtataatgatggattagcggaattaagaggcacaagcgttgagagttggctcaaatatcatcaatatcgtagggaaatgacagtaacggcaatggatttagtggcattattcccatactataatgttcgacaatatccaaatggagcaaatccacaacttacacgtgaggtatatacagatccaatcgtatttaatccacctgagcatccaagtggctttttctgcgaaagtttttatactatccgagcggctcgagaacgtttaactttttcgcaacttgaaaatgcaataattcgtccaccgcgcttgtttgaaaggtttcaagctttagggatttatacaggcgagctgcagctgggtcaaggtagtactccaatgaaccattggattggacattttataagaaatacacgtttaggggactcaacaacaattactacaaattatggaacaaccaataatcgtttaactaattttattcctcctactaccagtgatgtttatcaaattaattcaatctcaagtaatgcagcctcttttctaaacactttttttggggttactagagcacaattccattatggatcaggaattatttggtcgtatgtcggacaaaataacgttttgccaccatgtcttcaaaattataattcaatagaagaattaccaaatcaaagcgaggaacctacagttagaagttatagccatagattatctcatattacctcttttaatttcaatgtacagcttaatagtcctttacgttctagtggcaatatgcctgtatatgtgtggacacatcgcagtgtggaccttaataacacaattacttcagatagaattactcaattaccagcggtaaaggcatcgacactaggtgcgggggctattgtcgtgaaaggtccaggatttacaggaggagatgtaatccgaagaacatctgttggtaatttcggaagaataagggtaacggttaattccccattaacacaaagatatcgcataagattccgttacgcttctaccacagatttgcaaattggtataaatgttggtaatagaacagtaaatctttttgatttcccaagcacaatgaacagtggacaggaatcaaaatacgaatcttttgttacaagggagtttactactgcttttagttttacacaaactcaagagacaatctcagcgtttgcacaatcatttagcagcgggcaagtctatcttgatagaattgaaatcatccctgtgaacccggcacgagaagcggaagaggatttagaagcagcgaagaaagcggcggcgagcttgtttacacgtactagagacggactacaggtaaatgtgacagattatcaagtcgatcaagcggcaaatttagtgtcgtgcttatcagatgaacaatatgggcatgataaaaagatgttattagaagcggtacgcgcagcaaaacgcctcagccgcgaacgcaacttgcttcaagatccagattttaatgaaataaatagtacaaaagagaatggctggaaggcaagtaacggtgttactattagcgagggcggtccattctttaaaggtcttgcacttcagttagcaagcgcaagagaaaattatccaacatacatttatcaaaaagtagatgcatcggtgttaaagccttatacacgttatagactagatggatttgtgaagagtagtcaagatttagaaattgatctcattcaccatcataaagtccatcttgtaaaaaatgtaccagataatttagtatctgatacttactcagatggttcttgcagcggaatcaaccgttgtgatgaacagcatcaggtagatatgcagctagatgcggagcatcatccaatggattgctgtgaagcggctcaaacacatgagttttcttcctatattcatacaggggatctaaattcaagtgtagatcagggcatttgggttgtattgaaagttcgaacaacagatgggtatgcgacgttaggagatcttgaattggtagaggttgggccattatcgggtgaatctctagaacgcgaacaaaaagataatgcgaaatggaatgcagagctaggaagaaagcgtgcagaaacagatcgcgtgtatctagctgcgaaacaagcaattaatcatctatttgtagactatcaagatcaacaattaaatccagaaattgggctagcggaaattaatgaagcttcaaatcttgtgaagtcaatttcgggtgtatatagtgatacactattacagattcctgggattaactacgaaatttacacagagttatccgatcgattacaacaagcattgtatctgtatacgtctcgaaatgccgtgcaaaatggagactttaacagcgggctagatagttggaatgcaacaacggatgcatcggttcagcaagatggcaatatgcatttcttggttctttctcattgggatgcacaagtttcccaacaattaagagtaaatccgaattgtaaatatgtcttacgtgtgacagcaagaaaagtgggaggcggcgatgggtacgtcacaatccgagatggcgctcatcaccaagaaactctcacattcaatgcatgtgactacgatgtaaatggtacgtatgtagatgataatacgtatataacaaaagatgtggtattctatccggagacgaaacatatgtgggtagaggtgagtgaatccgaaggttcattctatatagatagtattgagttcattgaagcacaagag

SEQ ID NO: 7 - DNA, 2085 bp, Bacillus thuringiensis
gtgagaagtatgaattcatatgaaaataaatatgaactgttggatgcttcacaaaacaattataatatatctaatcgttatctaaggtacccactaacaaataatccacaggattcaatgaagcatacgaactataaagattggctggctatgtgtgaaaacagcccacagtatgatgttaatccagctgaaattaattcatcttcagttagtaccgctttaaaaatacttggaaccctcgttaagtttatagagaaaattgaaggaataggtcctgtttttacagcacttagtgcgatacttcctgttctttggccgcccaatactccaacgcctgaaagggtttggaatgattttatgactaatacaggaagccttattgatcaaacagtaacaactgaggtaaggaaccaagcgaatgcaatgatggcggatgtaaaagagaatctatatagatatacatcaagttttaacgcttggaaaggaacccccaccaataatccaaactatccaaactatttagcagctgtaataagagaatttggattagttgaggcaaaacttcgaagtgccgcagcttattttagcaatcgagtgggttatgaactattattattaccaatatatacacaagttgcaaattctcatttacttttaataagagatggtctcatatttgcaaatgaatggtctttagcacgtagtggtgacgaactttataaagaattttataggtataccagtatatacatttcacatggtattaaatattataatgagggtttaaatacacttaaaaatagaaatgtgccatggggtacatttaatgattatagaagagaaatgactatccagattttagatattatgtctcttttttctagttatgatgcacgtaaatatcctgcggatcgaacagatactacgatactaccaaaaacagaacttaccagagagatttattcagcactattagattctcctcctaataaaccaatagcacaattggaggaatcacttacaagagatgttcatttgtttacttggctaaagaatgtagaattctggacctttaattataatatgtacccagatacaaggtacttatctgctaatagaattggtttttcatatacaaattcttctgcaatacaacctagtggaatttatggaagtactgcatttggtacagcacttactcattcatttccacttaattcaaatgtttatagaatttctaccaaagatactacagcagtccctaatcaagttacaaacatagatctcaacttaatcaatggcacttctgcactttataattcaggtataataccagttcctaataatttaagaaccacactttttggattctcatcaaatgagagcagacctaatcaaccaactatacaagattatacgcatattttaagttatataaaaactgatattataggaggtcacaggagcagggtttcatttgcttggacacatagaactgttgatcctaataaccaaatacttacaaataatatcacacaaattccagctgtaaaatctagtctattaaatacacaagctagagtaattaaaggtccgggtcatacaggaggagatttagttgcaattacaagtaacggtactcaaagcggtagaatggaaatccaatgtagagcaagtaactttattgaacctgatagaaggtatcgtttacgcatacgttttgctgcaaatagtaatcttttagtaaatgtaacatatacatcaaacggtattcctagacaaacaccatttactactaatcttattcctgcaaataatgagatgtttttcccaggtaatacaataccggcagatttaaaatatgagtatttttattacagagagtcttttgatacaattttgccaatgcgtgtaacttcaggtgaactaataactgttgccattcaacctacaaatatgctttcaaatcaaatattgattattgatagagttgaatttattccgataacccaatctgtattagattatacagaggaacaaaatttagaaacagcacaagcagtggtggataatctatttacaaat

SEQ ID NO: 8 - DNA, 1818 bp, Bacillus thuringiensis
atgaatgaaaatgtgataagagcaaaagagtctgttcaatccttattttcaagtcctactaccttacaaataaacgccaccgattaccatgtggatcaagcggcaaaattagtagcatgtatatctgatcccatatacacaaaagaaaaactgtgtttgcttgagcaagtgaaattggcgaaacgtttgagtcgagctcgtaatctattaaattatggagattttgaatcacctgaatggtctgaagagaatggatggaaagcaaccactcgtgtgttcgtacaagcggattatccaatcttgacaggccattatctccatttaccaagtgcttatcaaacacagctgagtgatactgtctttccaacgtatgcgtatcaaaaaatagaggaatcaaagttaaaaccttatacaagatatagtgtacgcgcatttattgggagtagtaaagatttagaagtattcgccacaagatacgataaagaagtgcacaagaccctgcatgtaccagaggatagaatgccaacgaatctacgtacgggagaagatttagtggaaccaggatcccatcctatgatgacaaatccaatcaatccacagaatctgccctatgattcatgtggagatggctcatacgggatgatacaacaaacgagtgtggtgtgtgcagatccacatgagtggcaatgccatattgacacaggggaactagatatgattcgcaatctgggtatatgggtaggctttaaaattggaacgacagatggcatggcaacgatagatcatgtagaagtagttgaagtagggcagttaaccggagaggcattaactcgtatgaaaaagcgggaacaaagatggcaaaaaaagtgggcagaaaaacaaatacgaatcgaaagggctgtgcaagcagcaaaagaggcacttcaggcattattcacagattcaaatcaaaatcgactacaatcggctatcacactgaaacagattctagaggccgaaatatgggtgggacagattccttatgtatataacccattcctagtaggaaccgtaccggtggtaccaggagaaacatatgatattttccaagaactatcgagtaccgttgcaatcgcaagagcattatacacgcggcgaaatttgctgaggaatggagattttactgcaggattagcaaactggaataccacggaaggagcacaggtacaacaaatagggaatatttctgtactcaaactttcagattggagcgctactctttcccaacatgtgtgttgggatccggaacatagctatctgttacgtgtgacagcaagaaaagaagatgtgggagaaggatatgtgacaatcggtgatggtacgggagacaatacagaaacattacaatttacggtaggagaagagttgacaagcgtagccatcgttacaaacaggctcaatttgcttcagctgtataatgaatcttatggtacgaattcttctataggaacaactggaataagcagatatgcgaatgatcaagcagagagtttcagatttactccatacggtgatgaaaatagtagaagggattacacatctagtccgtatgaaatgaatgtgtaccctggtattaccaatagaccgatgaagcaaggaatgggttgtgggtattatgatagctatccgataataaaccaaaatatgccggatttttctagttatataacgaaaacagtggaaatcttctcggaaacaaatcatgtctacattgaaattggtgaaacagaaggaatatttcaggtagcaagtatcgagctaattcgaatggattgcgaa

SEQ ID NO: 9 - DNA, 1935 bp, Bacillus thuringiensis
gtgaaaaagatgaattcatatcaaaataaaaatgaatatgaatatgaaatattggatacttcaccaaacaactctactatgtctactcttcatccaaggtacccactagcaaaggatccatacaagcctatgcgaaatacaaactataaagaatggctagctatgtgtgcaaataataatcaagtacctattgatccccttgataatacctgggcaggtgttatggcagctcttttcgcctctgctgcagctatagcgggattaatgtcagcagttccagttttctctgttgtagccacaggaacagccttagcagcagccttaacacctattttattccctagtaatgggccagatgtatccacccagcttatgagtaatacagaagctttactaaaaagagagctagatacttatgttagagcaagggcagattcagaatttcaagccttagaagctcaaagagaatttttcaaatcagcttttgattattggagattaaatcctacaaatagtaatgcgatagctacggttgctgctaggttccacacagtaaatggggcttttgtaacagcaatgcgtttattcagaacggcaggttatgaagcattactgttaccagtttatgcacaagcggcgcgtcttcatttactccatttacgagatggtgtcctgtttgcgaatgaatgggggctagctaaagaccctggagacttacatgaccaagaatttaataaatatgctgctgaatatgcggattattgtgaatcaacgtataatacagagctaaaccgcattaaaactgctccaggtaaaacatggcttgactataatcagtaccgacgaattatgacaattgctgttttggatatagctgctaaattttcaattttaaatcctcgcctatatagattacctttgcaagaagaaattctcactcgaaaaatatatactgatcctgttaatttctcacctggtccttcaatcgcagatgatgaaaatagatatacagtcccaccatccattgttagacaattagttggctcaacattatatactaacgtggcatctgctcaaaatgctggatttattggaaatcgaaatcgttatttaaatataggctttggcgagacagttgacggtcctctaatcggaaactcagtatatgaaagtagggtagcaggtataccgacaaatgaatgggtttatgaagttggtgtaaatggtatacagaatgattatccacgaaatataggtttgagaaggggttcttcaactgattttataaataattatgctggaagtcagtacaatttaggtcctttaactagggtctctataccaactaaaaacaatgatccaataaataatataaattttactcatcgattatcagatataattcttcctggaaataggggctcatcttttgcatggactcatgttgatgtcaatcctacaggaaactatttatcaacaaatcagattaatttaataccttgtacaaaaatatctaaactaccaaattcataccaaataatcaagggaccaggatttatagggggagatttaatcagatttacaagtggcagcggatatttgtataagtttaagtttacatcctccggtagctcagctaattttaaaattcgtatacgttatgcaggtgctggtacgggtcctgggctttatgggcgggtattttttcgattaggaaattatcaatctccagacactccttggggccaaactggatttacctcttccaatgcgaagtataatcaatttaaagtattagagctttatggaactgcagaaaatattacagacaacgacttggagattatagtatggacagcaaactctggtgctcaggattttttatctagacagattggaattaatcccaatgccggggatatcaacagaatacaa

SEQ ID NO: 10 - DNA, 1701 bp, Bacillus thuringiensis
gtgagtcctatgtatattaatacgatgaaaaatacattaaaactagaaacgacagattatgaaatagatcaagccgccatttctatagaatgcatgtctaatgaacaaaatccacaggaaaaaatgatattatgggatgaagtaaaacaggcaaaacaacttagctggtctcgtaatttactctacaatggtgattttgaagaggcatcaaacggctggaaaacaagttatacgattgaaatcggaaagaatagttccatttttaaagggcagtaccttcatatgtttggggcaagagatgttttaggtgaagtgtttccaacatatgtgtatcaaaaaattgatgaatctaaattaaaaccctatacacgttatcgagtaagaggatttgtgggaagtagtaaagatctaaaattagtggtaacccgttacgggaaagaaattgacgccattatggatgttccagatgatttggcctatatgcagcctaatccttcatgtggggattatcgctgtgaatcagcggcaccacagtatgtgagccaagggtatcctacaccatatgcagatggatatgcttctgagatgtatgcatgcccgtcagaccgagttaaaaaacatgtgaagtgtcacgatcgccatccatttgattttcatattgacaccggagaattagatataaatacaaacgtaggtatttgggtcttatttaaaatttctaatccagatggatacgctacattagggaatttagaagtcattgaagaaggaccactaacaggtgaagcattaacgcatgcgaaacaaaaggaaaagaaatggaatcaacacatggagaaaaaacgttgggaaacacaacaagcctatgatccagcaaaacaagcagtagatgcattattcacaaatgtacaagatgaagcgttacactattatactactttagatcatattaagaacgccgatcagttggtacagtcgattccttatgtacaccatgactggttaccggatgccccaggaatgaactatgatgtatatcaaggcttaaacgcacgtatcatgcaggcttacaatttatatgacgcacgaaatttcataacaaatggtgactttacacaaggattacagggatggcatgcaacaggtaaagtagatgtacaacaaatggatggatcatctgtattagttctatcaaactggagtgcaggggtatcccagaacctgcatgctcaagaccatcatggatatatgttacgtgtgattgccaaaaaagaaggtcctggaaaagggtatgtaacgatgatggattgtaacggcaatcaggaaacgctgaagttcacttcttgtgaagaaggatatatgacaaaaacagtagaggtattcccagaaagtaatcgtgtacggattgaaataggagaaaccgaaggtacattttatatagatagcatcgagttgctttgtatgcaaggatatgctagcaataataacccgcagacaggtaatatgtatgagcaaagttataatggaaattataatcagaatacgagtgatgtgtatcaccaagggtatacaaacaactatacccaagactccagtagtatgtataatcaaaattatactaacaatgatgaccagcattccggttgcacatgtaaccaagggcataactctggctgtacatgtagtcaaggatataaccgt

SEQ ID NO: 11 - DNA, 3711 bp, Bacillus thuringiensis
gtgaaaaaaatgaattcatatgaaaataaaaatgaatatgaaatattggatgcttcacaaaacaactctaatatgtctaatcgttatcaaaggtacccactagcacataatccacaaacttctatacaaactacgaattataaggattggctgaaaatgtgtcaaaatcctcatcaaaatcccttagacatggaagggtatgatagtaattcagtcgttgtggtaagtacaggtttgattgttgttggtactttaattagtattttgagtgcgggattgggatctatacctataatttatggtactttattgcctgttctatggaacgatccaaacaatccgcaaaaaacttggcatgaatttatgagtcatggtgaaacacttttgaaccaaacaatatcaacagttgagaggaatagagcagcagcctatttggagggatacacaacagcagtaaaaaaatgtgaagaagcattaaatgtgtggctcacagcaccaaatcaagctaatgcacgaacagtagcagatttatacaaggacactgattttttatttttcacaactttgccccatcttaaacttcgtgactttgagacattacttctgagttcttatacacaagctgcaaatatgcatttaattttgttaaagcaagcttcaaaatacgctgatcaatggaatgcccaacttcctgtctctgttcggaaaacagcaaacgattattatactgatttagtaaaactgataggagaatatacagattattgtatcgcaacctacagatcaggattaaatacaattaaatctagagctacttcatggaatatatacaatatgtatcgtagagagatgactattttggtgttagatctcgtagctcttttccctgcatatgatattaaaaaatatcctagtggaactaaagtagagcttactagagaaatttatactgatgcacttggcgctgtagcgattccacaaaacattgatgctacagagcaattggcgacccgtgcgcctaatttatttagttggttaaagggctttaaatttattacgactcagtcaacaaataggtattatttatcaggtattgcgaatcgatatagctttaccaattctaatggagagatatgggggcctatttctgggaatcctactggtgtatcgtctgatttaaccatagataataatttttctatttacaaactttcaatattacgtggttatcaactctcaccagatttttcatttcataatccagttcaccaaattgatttttctacaacgaataaccaacagggacgagttcagtcatataaatcaggtggccctactcctgttaatccggagacgacagctattcatttaccgatagattcaaaatgtacacaaaactgtaatcctacatttaataattacagtcatatattatcttacgcaaaaactttcacatcaaatttaaccattggtaccacatcaaatatcacttcgtttggttggacgcataatagtgtggatcgtgaaaatacaattgatttaaataatattacacagattccagctgtaaaggccagtcaagtttatccagaaaactctgtaattaaaggtcctggtcatacaggtggaaatctggttagaattgatagtagtggttatatgtcaattgtttgtaaattcccactacaagtaaagggatatcgtgttcgtattagatatgcagcaaataatagagctgaactttatatatcgtcagctggaaatagtccaagtaaaaatgttgatctagaccctacattttcaggtactaactatgaaagcttaaattatacaaattttaaagataaagaaactgagtttataataacagaaggacagctcgttaaacaatcaataatattctcaaccaatggaaatgttctcctggataagattgaatttattccactgggaacgacaacctatgagtatgaagagaagcagaatctagaaaaagcgcagaaagcgttgaaagctttgtttacggatggcacgaatggctatctacaaatggatgccactgattatgatatcaatcaaactgcaaacttaatagaatgtgtatcagatgaattgtatgcaaaagaaaagatagttttattagatgaagtcaaatatgcgaagcggcttagcatatcacgtaacctacttttgaacgatgatttagaattttcagatggatttggagaaaacggatggacgacaagtgataatatttcaatccaggcggataatcccctttttaaggggaattatttaaaaatgtttggggcaagagatattgatggaaccctatttccaacttatctctatcaaaaaatagatgagtccaggttaaaaccatatacacgttatcgagtaagagggtttgtgggaagtagtaaaaatctaaaattagtggtaacacgctatgagaaagaaattgatgccattatgaatgttccaaatgatttggcacatatgcagcttaacccttcatgtggagattatcgctgtgaatcatcgtcccagtttttggtgaaccaagtgcatcctacaccaacagctggatatgctcttgatatgtatgcatgcccgtcaagttcagataaaaaacatattatgtgtcacgatcgtcatccatttgattttcatattgacaccggagaattaaatccaaacacaaacctgggtattgatgtcttgtttaaaatttctaatccaaatggatacgctacattagggaatctagaagtcattgaagaaggaccactaacagatgaagcattggtacatgtaaaacaaaaggaaaagaaatggcgtcagcacatggagaaaaaacgaatggaaacacaacaagcctatgatccagcaaaacaagctgtagatgcattatttacaaatgaacaagagttagactatcatactactttagatcatattcagaacgccgatcagctggtacaggcgattccctatgtacaccatgcttggttaccggatgctccaggtatgaactatgatgtatatcaaggcttaaacgcacgtatcatgcaggcgtacaatttatatgatgcacgaaatgtcataataaatggtgactttacacaaggactacaaggatggcacgcaacaggaaaagcagcggtacaacaaatagatggagcttcagtattagttctatcaaactggagtgccgaggtatctcagaatctgcatgcccaagatcatcatggatatatgttacgtgtgattgccaaaaaagaaggtcctggaaaagggtatgtaatgatgatggattgtaatggaaagcaggaaacacttacgttcacttcttgtgaagaaggatatataacaaaaacaatagaggtattcccggaaagtgatcgaatacgaattgaaatgggagaaacagagggtacgttttatgtagatagcatcgagttgctttgtatgcaaggatatgctagcgataataacccgcacacgggtaatatgtatgagcaaagttataatggaaattataatcaaaatactagcgatgtgtatcaccaaggatatataaacaactataaccaaaattctagtagtatgtataatcaaaattatattaacaatgatgacctgcattccggttgcacatgtaaccaagggcataactctggctgtacatgtaatcaaggatataaccgt

SEQ ID NO: 12 - DNA, 4299 bp, Bacillus thuringiensis
ttgtcaatgaatcaaacagacgtaatgaatgtaattcaagcggcagaaatagagggtattaaaagatcgcaagaaaagtatccaaatagggaactatctgttttccaacataacgtattgtcagggaatctgtatgcaaatctaaaacaaccgaccctcgttaccagtacagacattcaagaaacaaatacagtgaattgcaagtgttctctaaaaaaggcgccacatgtggttggccgaaatatgagtctttcatcatgtctagaacaatgtggagatttggatctacagattcaagcgatagacttgcaaacaggtataggcacagcattaagtataacctccattttagttaatccaggagtaggttctgcatttgcactaataaggacaattcttccgcttctttggccatcccaatctcaagatccaaataaagtatggcagtcaatgatggcaactgcagaagaactcgtagatgcaaaaatagataccgtaatgagaaatttagctatttcaaaattaaatggtataaaaagtttgatagattattttaatgatctaatctccatattagcgcaggaccccaataatacaaataagcgagaggcagtactagatgcatatagagatgtagatagggccttcattgaaagcatgccgcaatttgcagtacccggttgggaaacacaattattgcctgtttatgcggaagccggaaatcttcacctgctttttttgcgtgatgcggtaaagtttggatctgaatggaatatgaaccaatgggagattgatttaaattacaagtatttaaaagataacataaagtcatacaccaatcattgtgtaaactggtttcacacgggtttaaagaggctgaatccagaaacaaacccgtctcataaaccagctaacatgagagattgtacaaaatatccatggattgcgtatgatcaatattgggaagttaatcctaccagagattgttcacctactcttttaaccagtatttgtgaggagaaaacaaatgaatctccacctcaagtagcttctatatacgggtatcgagggtatcgagagtctagcggcgaatatcaaggattagagaattggaatttatataataatttcagacgtgatatgacgatcatggtattggatatactacctgcatggccaacatatgatccacaattgtatcctgatatagggataaaaacggaactcacacgagaagtatatactcaaatacgcgggacaacatatagatcgagcgccagtcaaaatacaatcagtgcaatagaatctcgtatgattcgaccaccaagtctttttacttggttaaccaaattggattttcagcaaattcacgtcacgtcaccgacaccgggacaggatccaggctacccatatacagcaggaaatcttctggttggtggatctcaatccctaatgtatactttgggagattcttttgaagagaactttggaaaaatcggaacacttccagttaaaaccgtaaatcttactcctgataacagtattacgcagttccaaacaaaacagtggtttgaaccaagagagattgcactctataaaagagacgcacatctatttactttgggaacaatcgaagagaaaactcctcatttctctcgcactccaggttgcttttacactaaagaatgtatctatgatccaacattaagagtaaatcagatgccaaaagcgatagatcctaataatcctaatgctccaagttcagattggaaagattcccatagtttatcgtattttaaatatgaaccagttcgtagtgattcgccctatggaaatcctaatgatggacaaataggagctgttctatttggatggacacatatacttgttgatccaaagaataaactagaatcagataaaatcacccaaattccagcggtaaaggcttctgagggaacaaattaccaagttataaagggacctggcttcactggaggcgatttagttaatttgaagacatatggttctttaaatataagtttgaccgttcccatgccctctctaaattatagattaagaattcgttatgcaagtaaggagcaaaagcgtataagattaaggatattacgcaacaatgtatggtcagaatatggagattttgatatacccactacatattctggtaatcaattaaccttcgattcatttaaaatttttactgtgagtacagtgttgttttcatcaacatctatactatatattgagcgcatagatcctttttcagaacttcttactattgacaaaatcgaattgattccgattacaggatccgtagaagagtatgaagccaatcaaaaggtagaaaaggcacgaaaggtcgtgaatgccttgttttcaaatactgtgaaacaacgattaagagacaatctaatggggattgatctagatattgccatgggcttggtagaagaaatacctgatgatcgatttccaaaagaaaaaatgatccttcgggatcagattaaacaggctaaacgtatgagtcaatctcgtaacctcctgcaatctggggatttcgcatcaccagattggtcaggagaaaatggctggacagttagtaacagtgtgtctgtggaagctacgaatcctattttacatggcaagtatctcaatctgccaagtgcccgagatccactatctgatggtaccctctatccttcttatgtgtatcaaaaggtagatgaatcaaaattaaagccatatacgcgctactggattcgcggattaatcggaaatagtaaagatttagaactgattgtttcacgctatcgcaaagaagtacacaaaaccttgcatgtgccagataatttgaatctaatgtccttacgcagccatctcgaatctttgagtggtcctgagattctggagcaagtacaacaaaaactacaagatccttcgtgtggcacctattcaccgctgatccaaataaacaacgagggtgaggatccacatatcttctcttgccacattgatgtaggggagttggatcttgcgtgtaacctaggaattgaggttgctttaaaagttcatacagtagatggaagagcacaggttcgttatctcgaaatcatagaaggcgcaccactaacaagcgaagaagtagcgcgagtcaaacgacaagagaagaaatggaaacaaaagagaaaacaaacatttactcagaaccaagaaacaattcaggcagcacaagaagcgattaaccgattatttgtgagcccaacatgcggtcgtctgaagctcacaacaacactacaagatattgaatatgcacaaacattggtagatgcaattccggatcgatataatcaaattctcccagcattaccaggtttgaatatggatatctttggtcgcatgcaaaaccaactggaactggcatatgggttatataataatcgaaatgttgttgttgatggtgactttatgagtggtcttgtgaattggaatgcgaccgaaggtgctgagatgcaacaaatcgacggtacatctgtcgtggtcatttcagattggggcgcaaatgtgtcacaagaagtttgtgtgaatccagaacatggctatctcttacgtgtgaccgcaagaaaagaagggcttggaaaaggctatgtaacaatcagtgattgtacagaaaacaataccgaaactgtgacatttgtatcagatgaagaaaggatggcgtctaccgaatcccttcgtgatacatctatagcgactgcgagagaaactccatatatgagcaataaccaaactatacatgtaccatctgattcatatgggaaaaacacatcctatgcaggaaatccaaataggaattactcatcagaaagttttggatttacgccatatggtaatcaaaatcaaatgatgaattattcacctatccatgatgaaatgaatgtgtatgcgaataatccgaacatgacaagtggtcatgaatcagggtgtggatgtggttgtcgtacaaatgcatacgctccggagtataagcgaatgaatcgaccatctaatcaggatgaaatgaacgcatatcctatgaacgaaagtactctgaccaatgatgaggcaaatgcatataaaacagcgtcgtatgcctccccgactccagtacaaaacagtacattcctttctggctatgtaacaaaaacagtggaaatttttccggaaacgaatcgtgtccgtattgaaatgggagaaaccgaaggtacatttatgatagaaagtgtggaattgattcgaatggag

SEQ ID NO: 13 - DNA, 987 bp, Bacillus thuringiensis
atggtgagagactatcctgattttgatgggatgctaaggaaagctgctcgaaagtgggcagaagcaaacagattgacattccaagatatttcgtatgcggatcctttaaccaattcggatacaatcagtctaaatgtcaaattcaaagatatcggatgcccagaagaatgtgtcgaattagaaagaataagcgtctcacaagcttttacgaataatacggggcaacaacaaaaagaaacatttaaaactacaacatatgtagaagatgagtatacttgggagaatgactatcattttgtgcttccaggacaaaacttccttatcatgccccgtcttcctcggtcagctcatagggatattaatccaggtttcctcgtgaatttctttggtgaaaatcaacaatttcatactaaaatgagagaactacgcccaattgaaggtgaagtgtttttagaaccatctagcagtgcaacgattcaactgcaagtggaaaaacaatatatttctcaaccgtatgaaattgaattatcaatactaggaagtattattgtgatagcacgagatagacagaaccgaagcagtgagaactatgttcgattaacagatctcatgccacttctctgcccttgtaaaaacttttcttgtagagggcgagcattggtattcgttgaacagggaacgttcaagggagtattgagtcgagcgatacgtgcatacgtcacacaaacgcttcataaagacggaaaaatgctagaatatgaaattcctttaaacgcatcacctgaaagggaaagggaattctccccacaacctttggcagcaagatgtatttcagacgaagaatcgaatgtgaatccttcgattttgtcatcgagaccatcgaatcctacagcctattcccagcaacctatgacaactaactctacatcctgtggatgttcttcctgtatgtctgaaaaatcaaatagcaatctatatataaatcag

SEQ ID NO: 14 - DNA, 1056 bp, Bacillus thuringiensis
atgaaaaagtattgtaatcccaataaagtaaatcctaatgaagtgaatccaacagaatttattttattcgacttggactattatttagatcataatatggcgaatgtggaaagttatcctatagagttgtactacatgctcgatgattataagccatcagggggttggcattttgatagaccataccttcctaccccaacttcttatcaagtacctaacgcttgcgtatcagtaaacggtctaaactattgtacctttaaaccatatcaagagaatgcttggtatgtagatacagccaatttgatcgcagaagggacagatacgtatgaagacatcgaatcaatggctctagaaacccctattattgcggatagacatgaatatcataataactcatctttacaacaatcctatgtgtccccagcctattcggaaacagtgactacaaccacgacaaatacaacaacacacggatgtaaagtaaatccaaaaatctcttattcgcgtaaatcgaaatataaagtcggcattaaggatatagaaaatggatttaacctggaattaggggccgaatataacttcagtaatacaaacacaaatacggctacgacaactcgaactgtgacatttccatcatttacgacacaagttccaccctataccactgcgattgtgacgattctattaaacaaaggaacgtatgccaattataatgttccagttcaaacgaatttatttggaagatttgatcgagtcgacatcagagacacccctcctagcgtgggcgcgacgtttgatctataccctttcgtagaattagttcaaacatgttgtgatgcaacttgtagtgattgtgtaacagacatggtgcaagctcttcctgacaatctcacggttcgttttaatggaacagggtcatttatagcggatgttgcatcaaataactttgtcgtaaatactgaatttgttgacaatgcaacaggagcaaccgtttcgaaaagaacagaatacgtacccgctatttacggacccgctaccacgtcggtaagcacatct

SEQ ID NO: 15 - DNA, 960 bp, Bacillus thuringiensis
atggtgagaatatatcctcgcttgaatgagctaatcagagaggccgctagaaaatgggcagaaaataaccaatttcgatttttaaggtctactttgttagatcctgatacaaatgatgaaactgttgttatgaataccacttttacagagataggatctccagaagagtgtatggacttagaaccccttcaaatcaaacaatcttttacaaataatacagatcaacaaacgacagaaatattcagagatgttgtatatgtagaagacgatttcacatgggaaaatgagtatgaatttaatatttctgaactcaaacttttaacgatcccgcgtgtacctaagttagcctataaagatattaatcccggattccaagtcgatttatttggtccgaaccgggtattttctaccaaaatgagagaaatgagaccgcttcgagcggaagtatttttagaaccacatagtagcgtcaatctgaaagcaaaagtggagaggcaacaattttctcaagaataccaactcgagttatcgatacaaggagatgttgttgtgactactgaaaggacaacgggtgaatctgaggaatattatgtgtcactaagagatttaataccatttttcgttttacctaataacttcactttggaagggcaagcactcgtatttcgtgaaaaaggaaaattcacaggcatattatatcgagcaatccatctctatgtaacacaaaccctttacaatgagaggaaaattctagagtatgaaattcctttattaccccctttagatgatcttagatctcgacttgtagaagcaataggggcaagaaggttatcaccacaagaagatgaatttactgttgtttcctctacttcacaaaccgtaccacctaaagaacaggaccagtgtggatgttcttcctgtctgtcttcacaatcaaatacgaatctatatacagaccaa

SEQ ID NO: 16 - DNA, 996 bp, Bacillus thuringiensis
atgaaaacctgtacaaataatagcaatccaaggaatactgttttattagagttggatgattatataacacacgttgttaaggaaaatgtagtactgggacctccagatctagtaggaagaaaaatgggttacccaccaggtttaggttcttggagaatggattcatcgtatttcccgactcctacttcgagtcaagtgcctggtcctccttgtaacactaccttcacttgtaggtactatccttctcctgcttggggttataatacaaatagcatgattgcggaaggtataaacaaagttatagaagcagaaactgtagctctagcacaacctattattatggatattcataattttagcaataatacaaatgttcaacaaacctattacactcctgaatattcagaagtaacaaccacaactgtaacaaattcaacaacgtctggaatcaaatctggaacaaaaatatcggcatctgttaaattcaaaatactaaaggctgagtttggagtgaatacagaagtaagttcagagtataatttcagtactacacaaacaataacaacaacgacatctcgaactgtcactttcaaagcacagcctgtagtagttgcacctcatactacggtgcaggtgactgtactattaaatcgagtagtgtatcaaaatgaagctgttccaattgaggctgatttatcaggaagaatttatagtgatgacggtagtgtaggcttggatttctatcctacctttgagtttttcaatcgttgttgtggaacagctgagtgctgtaagttaccagactctcttaaaattggttctaataataaagttcgttttactggaataggatactttcagtcagatgtaccatctaataattttcagataacgactgatattattgatgatgcaactggtgcaactatttcacgcgatgtacaatttgtcccggcgactttcgggcccattttaggaacaacaacttcaacttca

SEQ ID NO: 17 - DNA, 3948 bp, Bacillus thuringiensis
ttggcaaatttaaatgaaatttatccaagcttttacaatgttttagcctatccacctgcaaattttgataacgatcctagttcatgggaagtgtataagaagaatcagaaagaactaaatgataaatggaatgactatgatagcaacttcttaccggatcctgtaatggacacaataaatagtctagtaaatatatataaagatactcctgggagctatgtacagtttgcacaaatggcgataagagatgctttcctcgttttaccagggggccaaaccgctgcttgggctataaataaagtattaggccttatttttcctagtcatgaaaaatctctatttgaccaaattatggaggccgtaaaagaaatggtggaagcagactttaaaaacttagcattaaatcaaatacaggctgttattgaaggattccgatctcctctaggacattttagcgattcaatacagctcgctcttggaaaaccaacattcccaacaagttttcctccatctggagtaagtataattatgccttcgaattctactgactgtagcaaggattctgattgtaattgttccaatagcgcacctaatagtgattccaatgctgccccttgtacaccatgctcctgtcgtataagtaatgtttatcaagaattcacaaatacaagagatattattgaagctgctttaccaggacttctaaatcctttaaataacatattaaatggcacatcgatggccgactacatgaaaatgggtttacctttatatgtgatagcagcttcattgaatttagcattgcataaaaattatattgcttttgcacaaaaatgggattacgatccagccgggacaaatgtgattgtacgcaatttacgtgacagaattatagagtacagcaataacgtctatactatatttactaagtatttacctccattaacggataactccaaatcaggtctaaatgcgtatattcggtatacacggaacataactctgaatgctcttgatacagtagctggatggccaatgatgaatacaaacgattatcctattggaacaaatgtcaaattcactagaattctatttaatgatattgtaggtcctgttgaatactacaaggggagtcctacacgtgatgatagctcactccattttaacttgtacgatctaaacaaaaagcaattgcctaataactctatttcagattatttttataatgggatgcaattaagctctctcaaatttcaaacattttatcattcttataaagagtgctatcctcttggtcttgatgctagttatgatgctaacaatggtgtgcccataagacaactccaatcaaattcaagaggaaccagttggagcaataatctattcgaggattggccacttctcagttcccttaatatggcttctacccaaggcggctatgatgtggctaatattattgcggagggggacactatttcctctggatgcgatggggatccacgtacgatatcacacaacccagcgtatgtaaaccaaagaatacaagctatatatcctgtccagcctactaatccttcctcctatccaggctacggatctactgataaaataggtctgattactacacttattccaaatgatactacgtatctgattgatttgaatcctgaggaaatttctacgtttccggcagaactatcttacgatactaatggaacgacattaattgaatatatgaatggtgctgctgctcttcaacttatgcctaaccaatatgctaaatatatcataagtaattatgatatggatacttcttctagtcaaggtgtccaagttcgtgttcgagcagctacaactcaagatggtggctccctttctataacagttaaccaacaaacccaaaccttaaaactatcaaacaccacaaacactgattacacacaaatagttattaaaggcaaacaaggatactatgggctttttccaccaacagattcccaaaatcctaagcaacgaacttctaatattttccaattacctaattcatacaacaatactgcaataatccaaaataactctcaagtacctattattttagatcgcattgaatttgttcctgtttctgctcctgctcctgatcctagtcctgactctggtaagccaatacacaaatcagtgcctaagacagtgacacaactaagcacaacgaaagagatttggtcatctactagcgagtatgctacaactatatcttttacagggaatgtttataacgatgcttccattacatttcagttattaagttcaggtcaggtagtgaaagaatttccatttaccggaaacggggtcgcgagtaaaccaggttttcatggcagttcaccgtcctgctatgacacgccttatccattttcccaaccggacctatcagtgcctaaatataataaattgcaggtggtaatgaagagcgatggttactcaaaaccttgtgatcttggcgactcattccctaatacttttgatgcggaaatagacataaagtttaatttgagtgataccgcagacttagcacaaatcactgcacaagtgcagggattattcacatcttcttcatctacagaattatctccaaacgtttccggctatcaaattgatcaaatcgcactgaaagtgaatgcactatccgatgaagtattttgtaaagaaaaaatagtattacgcaaattagtcaacaaagccaagcaattcatgaagacacgtaatctgctgataggcggggattttgaaatacttgatgaatggggattagggacacaagctactatagtcgataagtcagcgttttttaaaggaaagcacctgtttttacagccgactaatggcatattttcatcttatgcttatcaaaaaatagatgaatccaagttaaagccctatacacgatataaaatttccggttttatatcacagagtaaagatttagaagtcgtggtttctcgttacggaaaagaaatcgataaaatattaaatgttctctatgaagcggcacttccaattacttccggtacaaatccaacttgttgtaaactgagtccatacccatcttgtgatggcagtcaacctgactctcatttctttagctatatcatcgatgttggtaagctatatccagacttaaatccaggaattgaatttggacttcgtattgtacagccaaatggacatgcaaaagtcggcaatctcgaaatggtggaagaacgtacacttacaagtacagaaattcaaaaaatccaaagaaaagaaggaaaatggaaaaaagcatgggatacagaacgtgcggaaattagtgcaacccttcatccagtcattaatcagatcaatgcattctatataaatggagattggaacggtcctattcttcctcatataacatatcaacagcttgctaacgttatattacccgcattaccaaaactaaaacattggtttatgacaaatcgtccaggtgaacactatgctatcctccaacaattcaagcaagctttagaacgcgtattcaatcaattagaagaacaaaacttaatccacaatggtagctttacaaatgaattgagtaattggctagtagaaggcgatgctaagattactaccttagaaggtggaaatctcgcattacaactctcagactgggatgcaagtgcatcacaatccattgatatctcagacttcgatgaagataaaaaatataaacttcgcgtatatgcaaaaggaaacggaacaattcaggatgcaaactgtgaaggtgggcaactgtcctttgatacaaacacattcaaatacctagaacgaacattatatttcgacacaccctctgttctcctacacatacaatcagaaggttctgaattcattgtaggtagtgtggaactcattgaattgccagacgacgaa

SEQ ID NO: 18 - DNA, 3885 bp, Bacillus thuringiensis
ttgattttcaaaaattcaaacaataattttttgttttattgttcaaggaggtattttatggtcattttaaatgatatttataaaggaccttataatgtattagcaaatccacctataattttagatacggaaaatccacaaaatccttgggattcttatgttaattggagacaggaactaaatgatagttgggcagaatatgatgaagattttttaccaactcctgtcatgaagataatagatgatatagcaaatgcatatgaaggtaaaccgggatcttatcttagtttagcgcaagatggaattagatttgcatttttatttttaccaggcggtcaaagtgcagcgtttgctatcaataaaatactaggacttatttttcctactcatcagccatctttatttgatcaaatcaaagatcttgtagaacaaatgattgatcaaaaatttgaacaacaagaaataaattcaaatataaatcgattgaatggattaattactcaattaggacaatttagtaattcaatacaacaagctttgggaaaaccaatggatttccctgtaactcatttatcttccacaacaaacaagttatttgacgatacaaatatatttgataccaattatgattgtagtacagatcctaattgttcttgttcagaaactcctaacagatcgagtgatgcatcaccttgtacaccttgtccttgtcgtattaaaggtgttcaagacgaatttatagctacaagaaaagttatactggatattctaaataatatgaaaacttcgttagatggtgtattaacaaaagaacatgcaacaacttatatgcaaatatttttacctatatatacaaaagctgcaacactcctttttggtatgtataaatcttatattgaatttgcaacaaaatataattttgaaatgggcgacaatggaaacacaatgaaatatacaaatgaattacgacaatatatttcaacagaatcttcttatgtttataatgaatttaataaatatttacctgattctaaagttttaacaaaaggagatttaaataaatatattcaatattcaagaactataactttaaatgctcttgatacagtatctacatggccattatataatattttagaatatcctatttctacaacgttaaatccgactagacttgtatttaacgatattataggacctgttgaatgtaaaactaacaatcagaatagtgacagtttatcatttagtacgttatacgattatacagggaataatcttttgaataatgatattaccaattatttctataaaaatacacaattacaaagtttatctttccaaagatataaatctcctaaaaataatccaatagcgcaagatataattgttggagtttcggctaattattctgatggaattcaatttaaaaaggaagcatcttggtctccttataaaggatatacattagaatgggaaaatgatgtattgaaggactatccaactcttagtataatgaacgcggtttctcttcaagataatggtggatttgtcgctatagatgaatcttggcttctctataacaatttgtcaagcgcttcttgtgcttctcaaaataatatagtttttccaaatcagaaaattcaatccatatccactctaactccaaataacactaaaaaatattcaaattatggaaatacagataaattaggtttaattacaacacttatccctaatgatacttctccatcaattattttaaataatccaataggaattaatacattttctgcagaacaagcaacaactactacaggaactagattagtagaatatgtaaatggagcagcggctcttcaacttaagcaggggcaatctgctgaatatattataaatactagtacaatattatcaggtaaatatcaagttcgttttcgagcagcaatgaatgatgcggataatgcttgccatctatcttttacaattaataattcaacggaaactgtaactttatccaaagatacaaatccattaaaaattgttggaaaacaaggcacatatatgatttcttccccaacctcttttcaaattccttctacaacaaagttatcaatgtctgtactgaatacaggtgataatgatgtaattttagaccgcattgaatttattcctgctgttattaataaagatcaaattaaaataccacctcaagatgtttatattcctttcaaaggacatactcctctttggaacagtaaggatgaaagaattgtaactcatgcaatatttgaacaaccagtccaaagaagatatttacgattatatttaaaagataagtatgtagatttagtacctgacgatggaattgttacgacgccttttgattcaattattctatataattctactgaaccatccgctgtaaacattcattttgaaggagctactcttactctatcaccccaaaatcaaaaacaatttactactctagaagacttagaaaaaatcacaaaccaagtcaatcagttatttacttcctcatcccaaacagaattggctcaaaccgtaaccgattataacattgatcaagtcgcactaaaagtagatgcgttatcagacgatgtatttggtgttgagaaaaaggcgttacgtaagcttgtgaatcaagccaaacaattaagtaaagcaagaaatgtattagttggtggaaactttgaaaaaggtcatgaatgggtattaggccgtgaagcaaaaatggtagcgaatcatgatttattcaaaggcgatcatttattattaccaccaccaaccctgtacccatcgtatgcgtatcaaaaaatcaatgaatccaaactacaaccaaatacacgctatacagtttctggttttgttgcacaaagtgaacaattagaagtcattgtttcgcgctacgggaaagaagtacatgacatgttagatgtcccttatgaagaagcgttaccaatttcttctgatgaacatccaaattgttgtcaaccagctggttgtcaatgtccatcttgcaatggtgatgcaccagactcccatttctttaactatagtatcgatgttggttccttacaatcagatgtaaatttaggaattgagttgggtcttcgtattgcgaaattcaacggagttgcaaaaatcagtaatctggaaatcaaagaagaccgtccattaacagaccaagaaatcaaaaaagtacaacgcaaagaacaaaaatggaaaaaagcatttgaccaagaacaagcagaattagccgcaacactccaaccaactttagatcaaatcaatgccttgtatcaacaggaagattggaacggttcccttcaccctcatgtaacgtatcaacatctgtctaatgttgtcttaccaacattatcaaaacaaagacattggtttatggaagatcgacaaggtgaacattacaatgtaacacaacaattccaacaagcattagatcgtgctttccaacaaatcgaagaacaaaacttaattcacaatggtagctttgcgaatggattgacagattggactgtcacaggggatgcacatgttactatccaggatgatgatcaagtattagaactatctcattgggatgcaaatgtatctcaaacgattgagattactgattttgaggacgaaaaagaatacaaacttcgtgtacgtggaaaaggcaaaggaacggtaaccgttcaacatggagaagaagaattagaaacaatgacatttaacacaagtagttttacaacgcaagaacaaaccttctatttcgaaggaaatatagtggacgtacaggttcaatcagagaataatgcattcctggtagacagtgtggaactcattgaagttgtagaggaa

SEQ ID NO: 19 - DNA, 3903 bp, Bacillus thuringiensis
atggataatatgacaaatttatctgatttatattcagctgttccttataacattatggtaactccaccattaaaagaatcctcttgggatgattttacggaattcataaaagaactaaaaggtggatgggaagaatttgaaaaaactggatatagcaaaccatatttaaatacccttgacgtggctattaatctttataaaagtggaaccttagattatacagctttagcaaaatcattcttatctattggatcagctcttggagaattcattccaggtggagctgtggttgttcctattcttagtggattagtagatcttatttttccacatttatttggatcaaaatcatcaaacagccaaacagaattttttgatgcaattataaaagaagtacaaaaaatgatagataaagaaatccaagattttacaacatctttattacaagctaatattcaaggattcgctgaagccgcaaaattatttcaaaatcaaatacaaagtgccataggagcaccgcatgcagtatttggtccaaaattagatcaaggagctacttgtaacacttctccttgtaaaacacctacaaaagaagatttactcactgttgaaatgcaatttacagcttcaaatacaactatggcttcacaagtccctcttttcttactaactcctacatcaagcgattcagatacaaatcgtgaaacaattatgttaaccctaccaatgtttgtaacagctgcaactgtacatttatctctttatcaaggatatattcaatttatgcaaaaatggaattctgtttatcctgaaattgatatagaatctcgtatatcagaattaggagaatatattgaatcctattccaaaaaagcattagatatctataaccaatatgcaccaacgtatgatataaacaacaaagatgtattaaataaatacattcaatacaatcgagttatgataacacaagtatttgatatggtatcaatgtggccttcttttttccctcaagattaccctgcaaaatttaaaaccgatcaaacacgtattgcatttggaaatatcgttggaccaacagaagaccagccttcgcttcattttgatctctatgatgtttacaaaaaccaattacctaataatgatatttttaattatttttataatggtatgcaactagatacattcgatcttttttcagacggtgataaccaaaaactacgcaattattttacgggaataaaaggttattacaaaacttataatgagaatgttatcactcaagatgaccctggtacaggtagacaaaacattgctcattcattttcctcagatgaagtgaaaaacttattaaatatcaacatgggttctgttaaaactcaatatttagattataacttattttattataactgtaagacatctaatccaggcaaaaccccatcttatactacaaatgattgtaaccagatagatataggtgctatatttaattctaaagatttgcatttatcaaacaatacttcatactctaatcaaaaactacaagctatttatccagttagaaatcctaagcaggtttggggtggtaccaacaaagcaggttttatctatacattagttgactatgatctatttcctcaaaatattataggatcagccaataaagatggcagtttaaacacaaatatccaaggttttcctgcagaaaaaggcactttaaatcttacagcagagcctttaacaaaagtattggaaccaattaacagtgcggcagctgtcaacttaaaattccagcaaatattagcattaccaattaccaatgtaactgatcaaaactatgaaattcgtgttcgatatgcaagtaaatctgacatttcgatttttttccatatccaaacacctagtgacgatctaaatagaggaaaccaaacgcttaaaaatacggaaaatgctacagatatcgcgattcaaggtaataacggaatatatactttacaaacattggcagagaaagtttcccttccttccggaaatttaaccgtatttattcaaaataatagtaattctgatctctttttagatcgtattgaatttattcctctttctcaaactcctgatacttttcctttaacttttaatccacctgaaactactacacaaccaaatacaacaaaaacaatttggtcaggtctaaaacctgctaatacattttctattcaaggtacagtttctaatgatgtttctataacattccaactttacatgaacgataacttggttcaagaaattcctgtaaaaggtcctggtcatggttattcctcaatggtaggatgtttagataaatcttcccctattagtcaaccaaatatagaaaataaagaatttaacaaacttattttaaaagaattaagtgataaagcccctgattgttttaacagtacactttcaaacacctacaaagttaatattaccatcgataacaaatcccaatcttttactactccagaagacttagaaaaaatcacaaaccaagttaatcaattatttacttcctcagcccaaacagaattagctcaaaccgtaactgattatggaattgatcaagtcgtactaaaagtaaatgcgttatcagacgatgtatttggtgttgaaaaaaaggcattacgtaaacttgtgaatcaagcaaaacaactcagtaaagcacgaaatgtattggtcggtggaaactttgaaaaaggtcatgaatgggtactgggtcgtgaagcaacaacggtagcggatcatgatttattcaaaggagatcatttattattaccaccaccaacgatgtatccatcgtatgcgtatcaaaaaatcgatgaatccaaactaaaatccaatacacgctatacggtttctggttttgttgcgcaaagtgaacatttagaagtcgttgtttcacgctacggaaaagaagtacatgacatgttagatgtcccttatgaagaagcattaccaattacttctgatgaacgtccaaactgttgtaaaccatctggttgtcagtgtccatcttgcaatggtgatgcaccagactcccatttctttagctatagtatcgatgttggttctttacaatcagacgtaaatctaggaatcgagtttggtcttcgtattgcgaaatcaaacggatttgcgaaaatcagtaatctagaaatcaaagaagaccgtccattaacagaaaaagaaattaagaaaatacaacgcaaagaacaaaaatggaaaaaaacatttgaccaagaacaggcagagttagccgcaacactccaacccactctaaatcaaatcaatgccttgtaccaaaatgaagattggaacagttcgattcatcctcatgtgacgtatcaacatctgtccgatattgtcttaccaacattaccaaaacaaacacattggtttatggaagatcgagaaggcgaacatgttgttttaacacaacaattccaacaagcattggatcgtgctttccaacaaatcgaagaacaaaacttaatccacaatggtaactttgcgaatggattaacagattggactgtcacaggagatgcacagattacgatctatgatgaagatccagtattagaactagcacattgggatgcaagtgtctctcaaacgattgaaattattgattttgaagaagaaaaagaatacaaacttcgtgtacgtggaaaaggcaaaggaacggtaaccgttcaacatggagaagaagagttagaaacgatgacatttaatacaagtaattttacaacgcaagaacaaactttctatttcgaaggaaatacagtggatatacacgttcaatcagagaataatacattcttagtagacagtgtggaactcattgaagttgtagaggaa

SEQ ID NO: 20 - DNA, 2367 bp, Bacillus thuringiensis
atgttggaagacgcgattaaaaataaggatacccagattactccggaattaataaaaaaacttcaggacaaaggatttgattaccttagtattgtaaagggtttaactggcggattactgaagcaaattccgtatgcaggttcaatcctctcccctttggtagttggcctttttccaggtaagggttatgtaacgaaggcgaatgtctggggagagatacaggatcgcgtttcaaatttaatagatcaaaaattagaagagtcacaagtaaataacttaattgggaaactaacgggtattcaggataatttaggaatataccaaactcgggttggtttagttaatgggataaaaccaccaattgctaattttatacaaaaggatgcaaattctgataaaaataaggagaatttaagaagcacaatagactccttggacaaggatttaggccgagtgatacctgagtttgctgttaaaggttacgaggcagcttctcttccatattatgtacaagttgccaatgtgcatcttttcttattgaaagatgcacttacacatgcagatgagtgggggcttactgatgatgaaaagagaggatatttgtcaagacttcaacaaaaaattcaagagtatagcagcgtcgtatatgattcctttaataaaggagtcgaagccgctaaaagtaagggtggaagtaccgccgacagttggaacagaaccaatgcctatgtaagaacaatgacattgtatggtttagattttgtggctttatggccggcttttgatactaaacattataatcagccagtaaaattgcagcaaacacgtgaattatattctaacatgataggaagaccaataaactggcaagactatgatacaactcttcaacaaattcataatagtgggtatgcgggttatccaggcgagctgaaacaagttggtgtttcacagtgggatcgtattgatggaatcagggaaatatttgattggactggagacggctcacgagattatacgctacaatggggccacgcaaacaaaaatgggtattcggaccgtagccagaccgtcaataacccagcaataggaatttcagcatatgaatccaataatgctaatttctataatatgtctactatcacatataaacaaaataacgaagtatcttggttctatggtccatttactactcaaagcgatagtaaagatggaagtagaatagatagcaaagctccagcgggccataaattatctcgcgtcaaagtacaagaaaaaagatcagatctaaatacaatatcatcttttgtggctgcatatgttcctgaagaagttcatccacagaatatacttgaggctaaagctattacaggggtaccagctgaaaaatatctcgcacatgcaggatttgaagataagattgaatacatgaatggttcgaatgcgatggtatcttctaaaaatggtgacacgatagattacaatgttcaaagtccaggaaaacaaaaatataaaatacgcctccgtgttgcgacaaatagtgacacatctgtgggaatctctataaatggggattctcagcaagtgaatataaaaaatacagaagccgcaacaaagttagaagacggtattacagttaaaggtgtaaatgggaagtacatgttaattgacggaccaactgttgaacttagcgaaggtgtgaatacaattcagcttaaaaatagtggtggagctaagattgcattagatcgaatagaatttgagcctataggcggtgagctacgcaagtggaaacaggaaggtgataagtggtacttttacgatgaaaatgataaaaagttaacaggttggcaaaagattaatgaaagaaaatactaccttggacattctggtgatggttctggtatgaccactgaaggggagatggcaacaggctggaaaacgattgatggagtacaatattactttggacattctggtgatggttctggtatggtcactgaaggggagatggcaacaggctggaaaacgataaatggagtaaaatattattttggacagactggtgatggctctggtatgcaacacgaaggggaaaaggcaacaggctggaaaacgattgatggagtaaaatattacttcaataaaactggtgatggctctggtatgcaacacgaaggggaaaaggcaataggctggaaaacgattgatggagtaaaatattacttcaataaaactggtgatggctctggtatgcaacacgaaggagaaatggcattaggagatatgacgattgatggagtaaaacatcactttaataaaactggtgatggaacgggtcgcgaccatgaaggagagctcgtatgg

SEQ ID NO: 21 - DNA, 2622 bp, Bacillus thuringiensis
atgaagaaacagatagtgagtgttgtagcatgtacagtattagctccgatgtttttacatgggaatggaaatactgtttacgcggacaataaaacaaaacagatttctccaacgttagaagatcaacagaaagagatggatcgaaaaggattacttgggtattattataaagaaaaagattttaataatcttattctttttgcaccaacgcgtgagaatacacttaggtatgaccaacaaacagcaaatgcattattagataaaaaacaacaaaactatcagtctattcgttgggttggtcaactccaaagcaaagagacgggagattttacatttcatttatcagaagatgaatatgcgatgatagaactcaatgggaaagtcatttctaataaagggaaagaaaaacaagttgttcacttagaaaaagggcaattagttcctattaaaatagaatatcaagctgataaaccgattgatatggatagtgaaacttttaaaaatttaaagctatttaaagtagatgctcagcaaaagtctcaccagatccaactagatgaattaagaaatcctgaatttaataaaaaagaaacacaagaattcctaaaaaaagcagcagcatcaaatctttttacgcaaaaagtgaaaagtaccaaggatgaagatgatgatagtgatggagacagtattccagatcgtttagaagaaaatgggtatactatccaaaataaagtcgctgtcccatgggatgattcacttgcaagtaaagggtatacgaaatttgtttccaatccactcgatacgcacacagtgggtgacccttatactgattatgaaaaagcagcaagagatttagatttgtccaatgcaaaagaaacctttaatccattagtagcagcatttccaagcgtgaatgtcagcatggaaaaggtgatattatctccaaatgaaaacttatccaatagtgtagaatcgcactcctctacgaattggtcgtataccaatacggaaggggcatctgttgaagctgggattgggcctaaaggtctttcctttggagtaagtgcaaactatcaacattctgaaacagttgggcatgaatggggaacatccacgggtaatacatcgcaatttaatacagcttcagcagggtatttaaatgcgaatgttcgatacaataatgtaggaacaggtgctatatatgatgtaaagcctacaacgagtttcgtattgaataaagatactatcgcaacaatcacagcaaagtcaaatacgaccgcattaagtatatctccgggagatagttatccgaaaaagggccaaaatggaattgcgataacatccatggatgattttaattctcatcccattacattaaataagcaacaggtaggacaactgttaaataatatacccattatgttagaaacagaccaaacagatggtacttatagggtaagagatgcacatggaaacattgtgaagggtggtcaatggaatggggttacacaacagattaaggcgaaaaccgcttctattatcatagatgatggaacacgtgtagctgaaaaacgtgtagcagcgaaagattatacgtacccagaagataaaacacccgaattaacgttaaaagatgccctaaagctttcatacccagaccagataaaagaaacagaggggttgttgtattataacgataaaccgatttatgaatcgagtgtcatgacatatctagatgaaaatacggcaaaagaagtgaagaaacaaatcaacgataccacagggaaattcaaggatgtccaacatttatacgatgtaaaactgacaccaaagatgaatttcaccatcaaaatggctgtattgtatgatggcgctgaaggcggggctagtagtaaatcaataggaacatggtacaatgctaactatgtaaatggaggaaatacgggaaaaacacaattccaatcaaagcattctagtgcatatgtagttctatcttcagaagcgaaaaagaaactaactcaaaatacgaattactatctgagcatgtatatgaaagctgattctaatatagaacccacaatagaagtagctagtgaaaaatcaacaataacgagtaaaaaagtaaaattaaataatcaagactatcaaagagttgatattctggcgaaaaattctgaaagtaatccgattgataaaatttatattaaaggaaatggaaccactaatgtatattgggatgatgttacgattactgaaatatcagctatgaaaccaaaagatttttcaaatgacgatattaaagtaaagtataatgattatagtgaaaagttggatacctgggatatgcgtttagataatgtagtttttaaaaatataactccttttcagaattatgtaacaaaatatagagtgaaatatgtggggaccattcctgcctggtcttttgataaaacattaaatagttatgaattaaattcggatggaagtcttatggtaaatattctagaatataatgacggtcggggaatagatttaaattccccatcaaaaaacgtcactatatatgctattactgatgatggaagagaaatagaagtttaccacaaagttggaagttattcg

SEQ ID NO: 22 - DNA, 1467 bp, Bacillus thuringiensis
atgtacgaagttataaaagaaaggagctggtgtcgaaaaagatactgtataactggatcaaataaaatttcaaaatgtgctggaagagaaagtcaatatgctgccttttctttcagagtgaggaggaatactttgaaaaaaaagatttgtacatgttttatttgtgtatctactttattgtccatacctatcttaggtgaaactacgcatgcttacaatagtgggaatttagatcatccaggttattctactaaaattaccgataatgtagtggactttaaagaagataaagaaaaagcgaaagaatggggaatagagcgagagaaagaatggaaactaacgaataatgaaaaaggaaaagtgaatgattttttaaacgataagaacaaaatcagaacaaattataaagaaattactttttctatggcaggttcctttgaagaggaaatgaaagatttaaaagaaattgacaagatgtttgaaaaagcgaatgtttcaagttcaataaccacttataagaatgtagaaccagctatgattgggttcaacaaacctttgacagaagggaatacaattaatgagaatgcaatggcccaatttaaggagcaatttttaaatagggatatcaagtttgatagttatcttgatacacatttaactgcacagccggtttccagtaaagagagagtcattctcaaggttacagtaccgagtgggaaaggttctacgactccaacaaaagcaggtgtcattttaagtgaaaatgaatacaaaatgctcattgataatggatatgtactccatatagaaaagatatctagagtagtgaaaaaagggtatgagtgtttacaagtagaaggaacattaaaaaagagcctcgactttaaaaatgatatcaatgccgcagctcatagttgggggatgaaaaattatgaagattgggctacaaatttaaccactgaccaaagagaagctttagatgggtatgctagacaagattacaaagaaatcaatgattatttacgaaatcaaggtggaagtggaaatgaaaaactggatgcacaaatcaaagagatttctgaggctttaggaaagaagccaataccagagaatgttactgtatatagatggtgtggtatgccggaatttggttatcaaataagtgatcctttaccttctgtaaaagactttgaagagaaatttttaaatacaataaaagaagataaaggatatatgagcacaagcttatcaagtgaacgtcttgctgcttttggatcaagaaaaatcattttacgattacaagttccgaaaggaagtacgggtgcgtatttaagtgccattggtggatttgcaagtgaaaaagaaattcttctagataaagatagtaaataccatattgataaactaacagaagtcgttattaaaggtgttaaaagatatgtagtcgatgcgacattagtaacaaaa

SEQ ID NO: 23 - DNA, 1137 bp, Bacillus thuringiensis
atgaaattcttatcaaaaaaagctatgacagggttacttgtaggagcaacaactctatctatctgggctcctgcaagtgaagcagctccagcgaataatcagtattattctattaatttgcaagctaatcaaaacttagtttgggatgtatcaggaagtttggagttacctggaagacctattaagaataaagatattattttatctaatgcaaacaataatgacaatcaacaatttgccttttttccacttgatgacggacgatatgcaattgtaaataaaaatagtgggaaatctgcaattggttttgatgaagctttgctagatgtgagttgggatggttcccctgctcaacaatggtatttacgagacaagggaagtaataattatgaaattgtaaatcaaggaaatgggaaagttgcatcttatgggaagttgtatactccaattccagcatcgattcaggagatagtggatttggatgactcaaatccttctgatccagatagggtattttacattggtaattctttatcttcttttgaattaccaactttaccagctacaggaaatagaccagatgctccaaattatactggaagcgttgatcaacaattacctcaaacttcaaattctgttgttgttggggcatctttaataccttgtattatggtaaaggatagtcaagcaagtgattatacaaaaatacacaattcaccatattatactttggtaaaagaagaatattgggataaaacattttcagcggttattccagctggtataactcgtacttattcatttaaaacaggtatgacttctgtagatcaacaaaagatgactgatacgctttctatgaaaattggagcagattttggattgaaatatggagactcaactgcatcacttaaatcagagatttcaagaacaatacaaacagaaattacttcaacggatacggaagcatcggaagaaacagttaatagtactgttacaagtgaacctggtaaaacaacaggatttacagaatatcaactggcaacaaaatatacgttaaagagagcagatggttcaattgtttcagatccttggattgtaaaaaataataagataacagtagcaagaaaaaatgcacaa

SEQ ID NO: 24 - DNA, 2679 bp, Bacillus thuringiensis
atggaaaggggaaagattatgaatttaaaaagtgtatttaaatgtttcacgattacagcaatactagcccaacttactgtatatccagcaatctcttatgcagaaagtaataatgaaaaaaatatggatatgaagacaacaataggagaaaaaaagggtgtaacaggtttagtaggttattattttaaagatgttcaatttactaatttatcacttattagttttggtgagcaaagcaaactagcgaatcaaacaaaaatgaagaagcataatcaaacctttgaatctgcacgatggatgggaagaataaaagcgtcccagacaggagagtatacattttctacagcatctgatcaaaatattattctgcaagttaacggagaaactatcattaatcaaggtaagatggaaaaacctcttaaattagaaaaaaataaagcatatgaattaaagatagaatatcaaaatataaaggatacatctccagacttacaattattctggtcaatagaggggaaagaaaaagagaagattccagaagagaatcttttatcgcctaatctctctgaaagagataagttatccaaagataataaagatacgttatttttaccagattttaatttatttaataattcgattgtcaaagatttaccagactcggaccgtgatggaatacctgatgaatgggaagaaaatggatatagagttcagggttacgacgagattgtaaaatgggatgatgttgaccttgcaaagggatacaaaaaatatgtatcaaatccatatagtcctaaaactgctaatgatccatatacagattttgaaaaagtagcgggttttatgccagccggaacaaaagatgaagctagggatcccttagtcgctgcttatccagctataggagtaggaatggaaaaattcatattttctaaaaatgataatgttacagacggacagtctggttccgtttcaaaaaccacatcatcgtcaacttcaaactcacatactgtgggagcaggcacaaagctagaactttcaacaaatccatttgctcttgctaaatgggaaatggcgcttaattattcttggactggtaactggactacaggattcgaagaaacaaacagtcaatcttggtcaagggagattcaaatgaacacagcggaacgtgcctatttaaacgcaaatgtgcgttattataatacaggaacggcacctatctataaaatagcacctacaacaagtcttgtattgagggatccaaaagatccattaaatgcaaataagactaccacaattaaaacggtcaaagctacaaatggtcttgtgggagagagtttaggacctgaaggaacatatccaagtcagggacttgcaggtcttgctttggatagattagaagacggaactagaatttcaataaatgcagagcagttggattcaattcaaaataatagtaaaaaattaagtttagaaactcctcaagttggtggacaatatggattactaagagatggtggtttagtaataaatgattttcaaacgtgggctccgattcaatcaggtattgatagcacttcaggagctttagtgttagatacggggaatattaatggtaatttagcgcgaaaagttactgcgaaaaatgaaaatgatcctaatgatagaacacctgtaattactataagagaagcagttaaaaaagcctttaatgcaaaagaaaaagatggacgattgtactatacagatcctaaaggaaaagaaatagatcttgatgaatctttaattacctttattttcgataacaatacagaacaagagattaaaaggcagctagagaacatgcaggataaaaaagtatataatgcaagatggaaaagaggtatgaatattacaattcgtacaccaatcgtttcttatgattttgaaaatactaacaatgttggatggtacggggctacagtagtaaacgggggatatacaggtaacaaacatgcacaaattgctccaaatggaaatggatatgcgaaaacagatcttgaattaaaaccacatacgccctatacagttcgtgcatatgtcaaaccatcagcagcaaatcataatgtagtattttataccaccaatgatggaaaaggacaagaatatcctacaactctgaatggagatcaatggcacgtaatagagtatacatttaacactggcgcacatccagaaaattttaaaaaactaggtttaaaaaatgaaggaaatgcaattcttaatgtcgacaacgtatttgtacaagaatggggagcagttctgggggaagatgcaactaacttaattaataatggtgattttagtgaaggattaaattggtgggaagatcataaaggtgagatcgaagatggatattttaaagggagttacttaaagagtaaccaatttaatattaaacaaaataaacaatatcaactgacatttgattcaaaattggacataggaagtaaccctggaaaaatatatgtatcgtttttagattcaggtatatctaatatagaaataaatcttgataattcttggaatcaccatagttataaaattacttttccaactgataaaaatgtaaaccttgcttttatatcgcttagtcctaaattcaatttggataatataaaatttgaagaggtgaaa

SEQ ID NO: 25 - DNA, 894 bp, Bacillus thuringiensis
gtgaaaaaagcaatattttcattattagcaactaccatgagcttggggatgattttgagtccagtaccccaaaatgttaaagctgctgaacagagtaagattagtgtatatcaagatttaggtgaaagagttaagaaaatggcacaaagtgcggctttaagcggatcagcttacgggcatcatactataagggatgcagaattaactggtagaaacatagaaagttcaatgactgaaaattccgaactcctaacgataggagaaaatattttagaaaataatttagggcatgatgcaacattacctactagtggatacgagcatttttttgaagataaaactagcacaactaatactacaggatggacatttggttataattttagtgcaaccctatctgttctgatggcctcagctacccataattttagtgttgattataatatgaccactgcacgtactgaggaaaaaacacaaaggaggacatttactctcccatcacagccggtccctgttccagctggaaagacatacaaagtagaatataagtttgaaaaggtttccatttcagggagaaatcagctgaatgctaatttatatggtgatgttacttattactataataatcaaccattatcccctcagcttttatattcagcactgggaagagcagctgatacgcaaggatttgagagaataattagagatactgtatcaggaaatgatagatttggaattagagctacaggtataggtctgttcaaaactgaatttggaacgcgtctatttgctagtattactgatattactaatccaagaagcccagttaagatagagactaaaacaatccccgttgaatttaaaactatttcagaaaacactagagtggttgaa

SEQ ID NO: 26 - DNA, 1005 bp, Bacillus thuringiensis
atgagaaattataaaaaattagcggttgcaatgccacttgctggtatgataatgagtggcgtgggagttttaggaggacctgcttattcatttgcagatacaatgcctcaagctaaagttgcgccaatgtatacgaatctagctgcagctgatcattatcaacagttcatggatatgctaaactcaaaggaaatgggaggagaagctgataattttgaaatagtagctatgccagatagtgggcctaaaaatatccatataactgaagcaaaaccaataaatgcaccagaaaatactacagaagttatgagttatcataatgtatcgggtattcaacaatcattaaaaacaccttcaaaaaaaataacacataaaaatacacttgcaataaaaaatggtggtagtattaaaacatctattgaatctaaaactaaattttcagtacaagtacctttctttgcaaaaggggaagaagagcttaaagtaggtctagatgttacttacaatagagagagtacggatacagcagaaaatacgcaagaatttacaattccagaacaaactttacttgctcaaccaggtggtacaacaagattaatatatactgtacaatctactgcattctcaggtacgtataacacaaaagctatatttaaacaaaaacaaggtggagaggcgaaaaaaattgtagatggaaaagaaatagaaggaaaagaacttgaaaagtggaatgaagaacaaggttattactttattaaagggcttttagaagacaaacctgaatttggaataaaagcacctgaatttggagatatttttgtgtttgatgatgtgaataaaaaagtatatttaaaagatggagtatttacatttgaaggtcaagctggacatcaatcaacagcagaagctgtatttattcctgatgacaatacaaaaccagaagtgaaaatgccacttgctgaatacaacagaagagtagcaaacggcatatctctttatgcaaaa

SEQ ID NO: 27 - DNA, 999 bp, Bacillus thuringiensis
atgagaaagtataaaaaattagcggttgtagtgccgttagctggtatgctaatgagtggtgcaggtgttctaggtggagctacatctgcacatgcagacggaataaaaatagatggtgtgcgtacgggcggacaaataagtggtaatcaaattgcagctgatcattatcaacagttcctgaatgcaatcggagaagaaggagaagctgataattttgaaatagtagctatgccagatagtgggcctaaaaatatccatataactgaagcaaaaccaatagatgcaccagaaaatactacagaagttatgagttatcataatataacgggtattcaacaatcattaaaaacaccttcaaaaaaaataacacataaaaatacacttgcaataaaaaatggtggtagcattaaaacatctattgaatctaaaactaaattttcagtacaagtacctttctttgcaaaaggggaagaagaacttaaagtaggtttagacgttacttacaatagagagagtactgatacagcagaaaatacgcaagaatttacaattccagaacaaactttacttgctgcaccaggtggtacaacaagattaacatatactgtaaaatctactgcattcacaggtacgtataacacaaaagctttatttaaacaaaaacaaggtggaaaggcgaaaaaaattataaacggaaaagaacttgaaggaaaagaacttgaaaattggaatgaagaacaaggttataaatttattaaatatcttttagaacctaaatggggacaaaaagcacctgaatttggagatatttttgtatttgatgatgcaaataaaaaagtatatttaaaagatggagtatttacatttgaaggtcaagctggacatcaatcaacagcagaagctgtatttattcctgatgacaagacaaaatcagaagtgaaaatgccacttgctgaatacaataaaagagtagcaaacggcatatctctttatgcaaaa

SEQ ID NO: 28 - DNA, 981 bp, Bacillus thuringiensis
atggaaaatgacgcgaagagtataaatcaaaagggtaatcgggctgagaacagagaagtttcaataaaagcagaagaacttaacttagaacagattttacacaaaatcggaaatgcaccaataggtcaacttattaactatgattatactttatatttacactataacactacgatttggaaagaagatccatttcatcctttcccagtttcgcctaaattagctcctacatcagggaatttaccatctcccgcaaaatatgctaaattagatggtttgcagttaaaagacgtaaagttggtagcaaacccagccgatttatttacgacattcaagccgttttacatggctgttggtaatttcgagaacaaaacatctaatcaacaaacttatcaaaccatagaattttctgaggcaataactgattcgacaaccattaccaaaaccaagtcactaaaaacaggtactgaagtttcaacgaaagctgagttggatgtattcggtttaggtggtgtagaagtcacagccaaggtaacagtagaaggaacgtggtcagattcgaatgcagagacaaagacaactacaagaactttaagaattcctcctatgtctgtactcgtagaccctggaaaaggggtacgagtacaagctgaagtactaaaaggtgaattgaaaaatgtgaacttaaaagcaaatgcattgttgcaaggttcctatatctggcataatcattctcatgaatataaaggagatatatacggattcttaaaaacaatacaaataactcataataagcaatttaatgaaattactggtgggggaattttgtttgatgatgcatcaaaaagcacaattgctcaaggattgagtttattaagtgccgatgtaacatcaagctcgtatcgggttgttttagaagaatacgatttaaaaacagggaacacaacaaaaaccacgccaataaaaacgtatcaattgaaa

SEQ ID NO: 29 - DNA, 975 bp, Bacillus thuringiensis
atgaaaaataataagaagaaaaaacaaattttatctctagctatgcttgcatctattggtacatcacttggaattatatccccagattcagtaagtgcggcccaaactaaccctattcaaaacactatacaggaacaaagaaatgtatctatatcagattggcgtacccctatccaagacacatacaaggctgctaaactttctagccctaatcgatttttatccaatgaagcacggcttgagaggcttcagatttatcaatcatcagtagaagcagatggttctcctactattactgattcaaagagtttatttgtcggaaaaacaacattaactaaccgttcaaatcaagatcaaatacttactacaaaccaattctcaaagactttcgaaaattctatcactaattctactacgcatggatttaactttggagtgagtacttctgcaacatttggtataaaatttcttggagaaactaatgtagaaatatctaccgaatataatttttcaaatactgtagcaaaaacaaagactgaaagctacacttatactgctaccccgcaaaatatcgtagttcctgcaaattcatctgtggaagttattgtaacattaaatactaataagataagtggaaatgtaaaacttcttactcacgtagatggtgaagttcgttatcagaataacccagcgaacttaggaagttggagaattgaaaaatttaaaggtttcttaggaagtatccatccgaaagatatttccaacaatttaaaagctcatccacagaatggtgtatatgtaataggaaccggtaactactcagctgaatatggaacagaattttctgtaactgtaagacctgtaacgaaccttaacacatctcctgctaaatcaagtagcatggtttctgaaaatagcaaagcaactaacgaaggttacacttatacagtaaaaccagaagttaaaaaagaacaa

SEQ ID NO: 30 - DNA, 1527 bp, Bacillus thuringiensis
atggtaatttataacaatcgaaaaaatggtattgattcaccatctattcgatcatcatatcctaatttcgtggatagtcatggacaattaacaatagatagaaatggatttaatgttaatcaatctattcagtatacaaatagaaattggatgaactatattcctgattctcataagataagtgaattatcaattccaggaacacatgattcaatggcactttatggtcctctagaccctatacctgtacctataggagacgaggcaacaatcactcaaacaatgaatcttgatattcaattaaactcaggaatccgatatattgatattcgctgcaggcattattatgatagcttccagatctatcatggccctgtatttcaacacgcatcttttaacgatgttttagtatccgtgaaaagttttttaactcaaaatccccgtgaaactattttaatgcgtgtaaaagaagaaatagaagacctaacccccccagtaggtaatacaagatcttttgctgaaacttttaaatcctatgtgagagggaatgaaaagtatttttgggattttttaaaaagccaaaatccatacaatccaacattaggggaagcccgagggaaaattattctactgcaacattttgacgccaatatatttctgggtataccttggtattcattagagccaaacgtacacgatatgtggcagttagatggtagaggtcaactatacgctaaatgggaaatggttcgagaacatttttttaaagcaatgagaaatagaaatcaaatatattttactcatttaagtggcactagtaaacttcctgttataggagagccaaaaccttggtttgtagcaagtggttacggaggcccgcaaaacactaatctgccacgtcaattatctggtccttcttctcaatggccagataacccacgcagtcccacatcaggctttgtacattacgggggaacgaacgttctttcgactagaagaattagagagcgtacatttactcatacaggaattgttattgctgattttcctggaaaaggtttaattgacggtacaattgcgttaaatttctctggaactctttctggtgattttcaaattgtaacagctttaaataatagtagtgtagtagatttaaatgtaggtagtaggaatgttacactatacgagaataataaagagaatcatcaaaggtggaattttacgtatgaccgatcagaaaatgcatatgtaatacacagtgtaagtaatacagaattagccttagcttgggatacttcaagtcctaatagaaatgtatttgctacatcaattggttcactaaggcaaaatgaatattattggattttggagcaaattgggaattatatatatatatttaaaaacaaaaaagataccaatatggttttaactgttgttggaggaattcaacctggtacaaatcttcaagtatatccaaaggccattggaagtgctcaaactaaccaaacttttgttcttaaatttatt

SEQ ID NO: 31 - DNA, 2049 bp, Bacillus thuringiensis
atgggaggaacatacatgaatcaatataacaatgatggatatgaaatcattgattcaaatacttcaccttaccccactaatagaaataatcaatattccaattctagatacccttacaccaataatcctaaccaatctatgcaacatacaaattatgaagattcacttattgtatctcaaaatattcaacaatataatagctgtgcagataactcatcatcaacagattggactccaattattagtacgggtttaattgtaggaggtactttgttaagtgctcttgttgcacctgtagcaatacctgttggaataggtgctgttcttatatcagttggcacagtacttcctatactttggcctggaggtacaaacgataacaatagaaactgggaaaattttattttacaaggaagcgctgtaacttgtgaagtaataacaactgtagtaaaggatttagtaaatacagcattaaatggtttaaaacaacaatatcacttttataatgacgctcttaaatattggaaagcaaacccaaatgatgtaaatgctaaaaacaacgtacagcaaatctttatatctctttatcaatcaactatagataaaatgtctatattttcaatgcaaggttatgaaacattattactatctgcttatacaggagctgcgcttttacaaataactttattagccgaaggtattcaatatgctgatcaatggggattagctcgaaactcgggagatttctatcgtgatcaattatataaatctatcagtaaacacattgagcattgtgaaatatggtataaaaatggtttaaataaattaaaatctagacctaatataagatggggtgcaattactaattatcgtagagaatatactttaagtgtattaaacattattgctacttttccagcatttgatttacgcgtatatcctctaaaagaacaaataggtcttcaagcagaatttacacaagaacttttcacaatatcaccagatgtgcaaaatttccaaaatttgccgactattttaaatctagaaaatgaactgatacctcgaccagatttagttagacatttaaaaagattatcgttctttacacgtactactgcaggaaatctcaataattatttagaaagtattacaaatgaatcttaccgtactaataataacagcacacatttagataactatggaaattttaataaccaaaatcagggtagtaatttaactttaacaaaccctgatcaagtcatttattttgctgatatacttcatcatgcttattataacccccctactatatttgggacatacggaattcgtgcaatagactttaaaattggaaccaatagacaaatatcacaaacactacgttattcatcaaatacaaatcccggcggtagtatacatcaaatatacgcaccattcccaccaactacacaatctaccaatttaacaaactatcaatatattttatctcgtataacaatgactaaagaatcttatcctatatggggaataggaacttttgaatcaactaaaatatatggatttaattggatacacgctagtttaaatctgacaaatagtattagttctataaatccaataggtaaaaagaaaatcacacaaatttctgctgtaaaagcttttgatatagatggaggttctgttatagaaggacctggccatacaggaggaaatttagttgaattaaaacgatccaattatataaaaatatcttgtaagattattgattcggctgtatataatttacgtattcgatatacttctaatacagctacagcagaaactaatggaatacgtataaccgtaattgataaaatcaacaaacgcacaagcaattatgctctaaaaaatacaattcgtaatcctcaaagaccaacatcgtatgataattttgaatatctaaatatagaaacattttctttctatggaacagatccaaatatagaaataatgttagaaaatatgtcaagtggaataattactattgataaacttgaattcactccacaa

SEQ ID NO: 32 - DNA, 3885 bp, Bacillus thuringiensis
atgaacataaatgataacaaggatgaatttgaaatcatgggtaatggtagcatggtctaccagccaaggtatccccttgcgcaggcaccaggttctgaattccaagggatgaattataaagattggatgaatcggtgtgcaaatggggagttaggagaattatttgtagattcagatgctgtgagaaatgggattgtggccggtctaggtgttacatcctttgtcctcagtataggatttcctgctgctgctgctgcagtaggcattattagtgtactgctgccattattgtggccggatcaagcaggacctcctgggactactgaagcgcaatttacgtgggatcaatggataactgctggggaagaattggctgctcaaacagtttccacttcagtaaaagaccgtgctatcgataccacaaggatcttacaatcacgtatgagagattatcaacaagcaatttgtaatttacaaacagatcccgataatgaggaatataaagcagacgtaagaagggaatttaatgatgccgaagatcaggcgaaagacgctgtaatccaatttggaaatttgaattatgcgattccattattagctgattacgcagaagcagctaatttacacttacttttattacgagatgtcgtaaaatttggagaaatctggggatttacggctcttcaagtgcaacaatattattctaataccggagtaggaaaccctggtatgaaacaactacttgcaacctacacggatcattgtgtacgttattataaggaaggtttagaaaaaagatacgcaacgggcaactggaatgcattcaatgattaccgtagaactatgaccataatggtaatggatatcgtgtcgctatggccaacctatgattcaagagtctatacacttcctactaaatcccaactgacacgaactgtgtatacaccttttgtgctaagttatcctaccccaaaccttcctttgatctcagagatagaatctcaggtagttgttcctccaagcctatttagctggttgtttctgatagaatcttatacggagaaggctgcgcaggataaagaatgtttaactggtcagagacaagcatttgcgtatactacgggtcgcgacctcttccaggagtttaaggggaatcttaacggaacctatagaggacagctggtggcagagccaggactaggacaatatgtttgggcgattgagttatatggttctggatatctatgggatgggtatccttacttacataatctgggattttttaactttaaattaaccaacagtgaggatcagaaaatacatgtttcaccaggagacattgttgatggaacaaccgcaatactcggattgccttgtaaacctaataataatgattgtgatccttgtaacccttgtaatacacttcctattaacttgagcaatccttgtaatgacatatcactgtatagtcatcgtttttcatatctgggtacgtatcctgctcctcctgttaataattggtctcctactaatattgggaatttttccttcggctggacccatataagtgcagattacgaaaatcagatagatgctgaaaagatcacccaaattccagcggtaaaggcagacggaatgggatccactgtaaaaataatcaaaggagatggtagcacaggaggagatttagtacagttaggtcaaggcccatcacacgcgacctttttaaagattccgatgggagggatagcccaaaaaggatatcaattacgaattcgttatgcactgtccgctagggaggacagtgagctagttgtagaaagattggtaggaaataggggtgatatggtgagggattattatgctagcacttggatgacgccaacatattcgggtgacccgttacaagtaaactacgactcttttggttatgctacgtttgagagcttgttacctcctactccttatagtaattgggagctaatattcgcaggtgatactgcactcatcgacaaaattgaattcattccaatagaaggatcggtggaagaatttgaagcgaaccaagctttagaaaaagcaagaaaggcagtgaacgccttgtttacgaatgatgcgaaaaatgccctacaattgaaagttacggattacgcggtagaccaagctgctaatttggcggagtgtgtatcagatgaattccatgcccaagaaaaaatgatcctactgaatcaagtcaagtttgcgaaacgactaagccacgtacggaatctattaaaccatggagattttgaattgtcagattggtctagtgaaaatggatggaaaacaagtcctcatgtccatgtcgtatctaataatccaatctttaaaggacgatacctccacatgccagaggcaacaagctcacacttttctagcaatacctatccaacatatgtctatcaaaaggtagatgaatcgaaattaaaatcgtatacacgttatctcgtacgtgggtttgtaggaaatagtaaaaacctagaattactggtggaacgatacggaaaagatgtccatgtggagatgaatgtaccaaatgacatccagtactctttaccaatgaatgaatgtggtggctttaatcgatgcaaaccagcatcctatcaagcaagacctcttcatacatgcacatgtaatgataccgctgtaacacatacaaattgtcagtgtaaagataaggggaatcgcaattcaacgaacatgtatacaaatgcgccaacagatagtgcggtatataggaatggatcccatgaccacaaatcctgcggatgtaagaacaatgacatgtaccagagcggaacacatccgcataagtcttgtggatgcaaggacccacatgtcttcacgtaccatattgacacaggatgcgtggatcaagaagaaaaccttggtttgtggttcgcattgaaaattgcgagcgaaaatggtgtcgcgaacatagataacctagaaatcattgaagcacagccgttaacaggagaggcgttagcgcgtgtgaaaaaacgagaacacaaatggaaacaagaaatggcacaaaagcgtctacacacggaaaaatccgtacaagcagcacaaactgcgattcagaatctgttcacaaacacgcagtacaatcgcttgaaatttgaaacgctgtttcctcatattgtccatgcagacttgctcgtacaacagattccatatgtgtaccatgattacttgttgggatctatcccacctgtaccaggtatgaattatgagatgtatcaacaactatcggtaaagattggaaatgcacatgcattatatgagcaacgaaatctcgtgcgtaatggtacattcagctccggtacaggaagctggcacgtgacagaaggggtagaggtgcagccactgcaaaacacttccgtactcgttctatcggaatggaatcatgaagcgtcccagcaattacgtatcgatccagatcgcgggtatgtgttacgtgtaacagcccgaaaagagggttctggaaaaggtacggtgacgatgagtgactgtgcagactatacagaaacactgacctttacatcttgtgactacaatacgatcggtacccaaacgatgacaggtggtacgttatcgggatttgtgacaaagacgctggaaatcttcccagatacagatcgcatccggattgatatcggtgaaacagaaggaacatttaaaattgaaagtgtagaactcatttgtatggaacaaatggaaaaccatttatatgatatggcggggaacttagaggaagagatgctggatctgcagtcagctcgttccggtagtagcacgttagatcatatatgtagcacattaatcggtgattttggctgt

SEQ ID NO: 33 - DNA, 3774 bp, Bacillus thuringiensis
atgaatcaaaattacaacaacaatgaatatgaaatgatgggtactggcggcatggactatcaaccaagatatcctcttacgaatgcaccaggttccgaattccaacaaatggattataaagattggatggatatgtgtactaatgagtcagtaggagacgtattcggtgacactgcgaacgctgttagggatggactcattattggtacaggtgttgcatgggcactccttggtcttattccagttgttggtggtccagcatccgcaatagcaggactttttaatgtattgttgccatactggtggccagaacaagctggagcacctggaacgccccaagcacaattttcatggaatcagttgatgactgctgcagaagagatggtcgacaaaaagattctggagagtaaacgaggagaagccactgcaagatggcaaggtatacaactattagggagagactattattcggcgctctgtgattggataaatgaccaagacaatgcagtgaagaaagaaaggttacgagatgcatttgatgacttagacgatcagttgaaacttgcgatgccattctttagtgtgcaaggatttgaacttcccatgttatctatgtatgcacaagctgctaatatgcacttgcttttgttacgagatgttgtccaaaatggggtgagttgggggtttgcgccatatgaggttgatcgctattatttcgatccaagtggccaaaggagcccagggttgttacaactcctaggcatttatacaaattactgtgtagaatggtatgagaaagggttacaggagcaatataacaccggtcgctgggagaaattcaataatttccgtagaaatatgacaatcatggtacttgatacggtagcaatatggcccacattcgatccgagacgctatccactacccacaaaatcacaactgacacgaactttgtatacaaacccagtaggaagaggcggttatagggaaaatatggattcgttggaaaacgatctagttgctccaccacaattatttacatggttacgtgaaatcgaaatacctgttgggatagtgtatttggatgacagagctccgcttctttgtaaacagaccctccagaggactctgagttctacgacatggtcgataacgcagggagaaattacgactccagtaatagacacacttaccctgactattgaaaacccatactatcaggatgatgtctggaaagtgaacactcatggtatcagcggtggcactgataccgtaacgggatggacgttcaattttataaaatcgcctgatcaaactttaatggttaataacaacatacatccgggttctgtgacggatagatggagtgggttcccttgtagaggtaatgattccgttatttgtgatccatgtgattttgagaacacttgtagaaaggaaacacctaacacgtctgttccttgcgatgataaacaacactatagtcaccgattgtcatatgtaggtgcccagggtggaagaagagatgtctccaccccattcgagcttatacggtttggttatggctggacccatgtaagtgcagataataacgtgctagatgagaaaaagattacccaaattccagcggtgaaaggatatcttacaaatggtactgtgataaagggtcctggtagtacaggagggaatttagtaaaactttctgaaaatgatgacctcaatataaatgttgcagtcttaccgccatctggctcagcattagtatacggatataacataagaattcgttatgcaagtagtgcagagactcggctccttgtcgagcaagtttttgacgacaatgggccttatatatataatattccatctacgtcttctgctgatagtctaacatatcaatcttttagctactacgatttgtcatttcatcacattggtccaggaataatagaaactccgacatcatctagtctattttttcagaattcaggtgggggagatatcatcattgataaaatcgaattcatcccaagaaacacacctggggcagaatatgaagcgaatcaagctgtagaaaaagcaagaaaggcagtgaatgctttgtttacgaatgatgcaaagaatgccttacaactgaatgtcacagattacgcagtggatcaagccgctaatttggtagaatgtgtatcagaggaattccatgcacaagaaaaaatgatcctactggatcaagtcaagtttgcgaaacgtctaagtcaaacacgaaacctattaaactatggggattttgaatcctcagactggtcaggagagaatggatggagaaccagtcctcatgtccaagtggcatctgataatccaatttttaaagggcgctatctccacatgccaggtgcgaggagccctcaattttctaacaatacttatccaacgtatgcctatcaaaaagtggatgagtcaaaattaaaatcctatacacgttacctggtacgtggattcgtcgggaatagtaaagacctagaattattggtagaacgatacggaaaagacgtacacgttgagatggatgtaccaaatgatatccggtatacgttaccaatgaatgaatgtggtggccttgatcgatgcaaaccagcatcctatcaaacaagaactcctcatacatgcacatgtaaagataccgctgtaacgcatacagactgtcagtgcaaagacaaggaaaatcgtacttcgacaaacatgtatacaaatgtgccaacaggtagtgaagtgtatacgaatggattccatgctcacaaatcttgtggatgcggtgacaaacacatggataagaacggaacacatccgtacaagtcttgtggatgcaaagacccgcatgtcttcacgtaccatattgacacaggatgtatcgacatggaagaaaacgtaggtctattcttcgctttaaaaattgcgagcgaaaatggtgtcgcaaacatcgataatgtagaaatcattgaagcacatccgctaacaggagaggcattagcacgtgtgaaaaaacgagaacagagatggaaacaagaacgtgataaaaaacgattagaaacagacaaagccgtacaagccgcacaaaagacgattcgaggtttatttaccaatacacaacaaaatcgtctgaaatttgaaacgttgttccctcaaattgtggatgcggagatgttggttcagcaaatcccatatgtgtaccacgattacttactgggtgctatcccacttgtaccaggtatgaattatgagatatatcaacaactagcagcatccattggaaatgcctatgcattatatgaggaacgaaatctcttaagaaatggtgcattccgttccggtacaggacattggcatgtgacagaaggagtaaaggtgcagcgacttcaaaactcatccgttctagtcctatccgaatggagtcatgaagcatcccaacaggtacgtattgatccagaccgaggctatgtattacgtgtaacggcgcgaaaagaaggcggaggaaaagggactgtaacaatgagtgactgtgcagcgtatacagagacactgacctttacatcatgtgactataacacgtcaggttcccaaacgatgacaagtggtacattatccggatttgtgacgaaaacgctagaaatcttcccggacacagatcgcattcgtattgatattggggaaaccgaaggtacgtttaaggttgaaagtgtggaactcatttgtatggaactgatggaggaccactta

SEQ ID NO: 34 - DNA, 2052 bp, Bacillus thuringiensis
atgaatcaaaataataataatgagtatgaaatcattgattcaaagaatttaccttgtccttctaacagaaatattgactattctagacacccttttacaaataatccgaatcaaccattacaaaatacaaattacaaaaattggatcaatatgtgtcaaaagaatcaacaatatggtgaaaatcttgaaacttttgctagtgctgatacaattgccggagttagtgcaggtgttattgtagtaggcactatgttaggagcttttgctgctcctattacagctggtcttatcatatccttcggaacactattgccgattttttggaaaccaggtgaagatcctaaaacagtatggcaagcatttttaaaaataggaaatagaccttttagttcaccagtagatcaagctctaattgatttactatctaataaagcaaggagtttagaatcgcaatttaacgattttcaaaggtattttgatatatggaataataataaaactccaggaaatgctggagaagtactaagaaggttttctagtttagatgctgatataataagagaattagaacaattaaagggaaactattatatcacggtacttcctggttatgcacaagtagctaattggcatttaaatctattacgaatagctgcattttattacgaccaatgggcatcttcatctaacttatcaatacaaagtatatatcctgaggattatattaatgatcttcagacttgcctaacgaattgcgcaatagaaagtggtaataagatatcttctaaatactataaatgcgtattaaaatgtagaattaatgaatatattaattattgttcaaaaacatatcaagagggcctaaatatacttaaaaattcaagtggtgtgaaatggaatgagtataatacgtatcgtagagaaatgaccataaatgtattagatcttattgctgtttttccaaattatgacccagataaatatctaataagtactaaatctcaacttactagagaaatttatacggatgctttaatagatgcatttgctaatgctcattttaatataaatgacattgaaaatagtttaacgagaccaccaggtttagttacttggataaatcgtttagatttttatacaggaaaattccctggggatgttcctggattaactgccaatagtattaattattcatttacgaatggtaattcaaatgatagtccaatttatggatatcgtttaagcggtgatagtagaaatccagttcaaataccccttaatcaatatgtttataatatgttaatcacatatttaagtaatagccctagcgtaatacaaaagattgattttaatttaaacaatcaacaaacacgtatttatgatactgggctaacattatcacctatttaccaaagtactataaatttatcattaccaggaaaggatagatcattcccacccaaatttaataactatactcattttttatcttatgtaaaaacagctcctggtgatgagagaccatctagctcaagggcaagaaatgtttgttttggttggatgcattttagtgttaatgattatgatgtacttgcgggtggttataatataatctttgatacaataattacacaaatacccgctgtaaaagctagacatttacctctcccgtcttttgtgatgcctggtcctggtcatacagggggtaatttagttgttctttcaacccaaatagaatttcaatgtattgtacttaatcctgtatcctataaaattcgtatgcgatatgttgcatactctcctaatcgttcaattaacctaacagtaagtataagaagcgaaataggaaattatcaaaatatagttccaaatataagttccacagttcaatcacctgaagatacaaaaaatcctaaatatgagcactttcaatatttggatatatcaataccgttagaactatttggaataactaatataactattacaaggtcagacagtatatctaacaatacattgattatagataaaatcgaatttacccctgacgtg

SEQ ID NO: 35 - DNA, 2280 bp, Bacillus thuringiensis
atggaggagtgtggcaggtatatggctaatgaaaatagtacaaataatcctgatactaacaataaccctatatataatgaaaatcaaaatgaaaattatggtgatactaatggatattcgtctgaacctggggtgaatgacacaaatgtatattcaaatgatacttcaggatatgcaaacgatactaatgcgaatacaggtgattacaatactggcactatcaatagctctgaaatgaataatgatacttataacagtggcaatgtgaactacttggtagaaaatccaggcttactggaagaagttccccaagtaccttacaatgtggtagcgaaaccactttatctacaaacagacgaagaaacggaagaagcttggaggatttgggaaagcagagatcctagtatctttataccagcccttgttgggataattggttccatgttactaaaaaaagtagctggattaattatcgatcgcgcactaaaaaaattatacggatatctattccctggtgacgcacctattacaatgttagatattttaagagcagtagaagagcttgttaatcaaagaatcgaagttgcagtacggcaactagtggaggcagaattagagggcttacaaagagctgtaaaatccttcgaggatgacgtagctacctttgaatcatctcaatcacccagttttatggaagagataacaaaagttatacaaacagaagaagccatacgaacaggagaagaattacccactccaacagcgattatagattctgttaatcgcctaaacgcgacttttgcacaagccatccctaaattccgattaccagattggaaaaaccaatcattgcccctatatgcacaagcagccaatcttcatttattttttcttagagatgttatcgataacgctcaaaaatggggtttaacaactagtgaaataaatcgctataaaaatgacttgaaaaattacatccaagaatactccaattattgtatatccacatacaaagcggaatttgatcgtagatttcaaaatacaagatttgacaaggcgttagaatttcggaactttatgacactgaatgtactagactatgtcggaatatggtctatgttacgatatagtaacgtagttatcaattctagtatgaatttgtataatactacttgtcgcctagctctcccacttgctagctggaattatctcaatgcaatgatgcaaggtcgaccaaataaaatactcctagccctggggaccggtcgtcttgagacgtatcacccacttatacctgggccgacgcctggaagcatcgctataccagctgaaacgtcaaatcgttatttttacacaggaactcattacattaacggaaattctacgggaactgtgggtttaattcctttgcccgattcccctggatctctgttcacaaaatgggaaaaaagtattcccgctttctatgtaaccgatccagtacggtccccgtggatagttgctaaccttacccgtactataacgtcatcaagtagagaacgtgtggataacgaaagcattagattcagctcgagacgaggtgaccctggaactcaatacccagattattacattaggaatgttacgggtctaccaaatagattaagtgatccatatccagatatagtaaatggtttttggaataagaaaacaactacagcacaaattggagtgactgcaacgttcaatcgtacgattatttccgcacatacaaataatggatctattaagcatattgttccgtatgtagcagatgaaacaaatcttgcggtgccaaaaccacgtggatttactattttaccattacaacatgattgggcatacaacggggatggatctaataatttactccgatttagcgaaaaattcggaaataatggtgatgccatcagtatccctaccgctgcaggaggtagcaaacatgtccggttcaattataaaattgataataccggttcaacggatgtgtcctatgacgtatatctaaaagtagccactgtgggagcaggaacgactaacttctttgtagcaaaaaatggcacaggatatggtaaaaatatttcaacagcaacttctaacgatggtattactgataatggtgtgaaatttaaagatattttaatctatcctaatatatcaatacctaaaaatacacaagttactttagaaataactgtttcaggtagtgcagcttatttaggacagattatatttgtaccaagaggcgtcacaccgatttat

SEQ ID NO: 36 - DNA, 4566 bp, Bacillus thuringiensis
ttgcaccagaaccgtaatatacgagggggtttatacatgaattacaataacaatgaatatgaaattttagataatggtaatataggctatcaaccaaggtatccccttgtgaattcacctggtgctgaatttcagcaaatgaattacacagattggatgaataggtgtaattatggggaatcaggagaagtattcagctctgctagggatggggttattatcgctacaggtattggctgggctattctcggatttattccagttattggtcctggattatcagcagctgcgggtgtattaaatgtaatactttcatacttatggccagaggatgctggagctcccggaactgaagtagcacagatttcttggaatcggatactgagaactgtggagggactgattgatacagcacttagtagtgttataaaaaccgttgctacaactgaactacgagacttgcaagaagatataatatcttataacctagcgctatgtaatttgaaaacagacccaaataatgaaacatataaaacgacggtaagacgggaatttgataacgccgcagatcaggcgagaaaaactatattagcaatgagtcctataactcctgatcagccggctgagactaaaaaaaatgctatattactattagctgattatgcacaagccgccaatctacacttgcttttattacgagatgtcattcagtacggagaaagttggggattttcaccccttgaagttcaacaatattatgataatccttctggcagaagtggcatgaaacaacggttagaagaatatacaaattattgtgtgaattggtataatgtagctttatcggatataagagcatctggcgtctattttgataataaatggagacaattcaatgcttttcgtagagatatgactataatggtgctagacattgtgtcgctatggccaacatttgatccaagattatatccagtttccacaaaatcacaattgacacggactgtgtatacagatccaataggaattggaagttcatcaggcatagattttacaaccgtcccctttgaccttgtagagagtagcattgttgctgctccaaagttattcagctggctccgtaaacaagagtttagtttcaaagattgggcagatgtataccctatagcaggctataaaatgacatttcagaacactttgagtgctgcactctgggaagggagttttatagggactcgtgatctttcgtatgttgtggaaaaacagacccttactattccagacccacaattgaacgatgacatttggcagattgggacgaactccgatagtgtaagggggactgtttacggatggtattttccttttactcaatcaccggatcaatatatcggcagcccggatctcgatcgtaaaatattatcaggattaccttgtaaaggtaataatcctagtatttgtgccccttgtcaatctgaaaattcttgcaacggtgggcctttaaacacaacaaatccgtgtaatgataaacaaatgtatagccatcgtttttcatatatgggtgccggtgctagagagcttgctgccccttacaactccttaactttttttggttacggctggactcatatcagcgcagatccaaataacctgatagatgctgaaaagattactcaaattccagcggtgaaggcatcctcaattagtggagatgccagagtggtaaggggacctggtagtacaggtggggatttagtaaagttttctgcaccttctaatacttttactaacatagggctatggacaacgataccagcaggaattcgagcatatcgtgtaagaatacgttatgcaagtaatgcggatatccctttagatgttcttatatccaggacaggttacggtacctttattgccccagcgacgactactgatctaaataatctcgcatataataaatttggctacctagatactcttgtttttatgagtgatgaaccaaatgaacagtatgaacaagatatcaatttctcgcttaatcaagtggctgattcaggaactctcatcctcgataaaatcgaattcattccaatggaagaatctttagaagaatatgaagcgaatcaagctttagaaaaggcaagaaaggcagtgaatgctttgcttataagtgatgcgaaagatgccctaaaattgaacatcacagattacgcggtagatcaagctgctaatttggcggagtgtgtatcagaggacttccatgcccaagaaaaaatgatcctactggatcaagtgaaattcgcgaaacggctgagtcacgcacggaatctattaaactatggagattttgaatcctcagattggtcgggagagaatggatggagaaccagtcatcacgtttctgtcagatcggataatccaatctttaaagggcgctatctccacataccaggtgcgacaagctcacaattttctagtcatgtatatccaacttatatctatcaaaaggtagatgaatcaaaattaaaatcgtatactcgttaccttgtacgtgggtttatcggaaatagtaaagacctagagttattggtagaacgatatggaaaagacgtacatgtggagatggatgtaccaaatgatattcagtatacgttaccaatgaatgaatgtggcggctttgatcgatgtaaaccagcatccgatcaggcaagactttctcatacatgcacatgtaacgataccgctgtaacacatacagattgtcagtgtaaagataaggggaatcgcacttcgacgaacatgtatacaaatgtgccaacaggtagtgcggtatataggaatggatcccatgaccacaaatcatgtggatgcaagaacaatgacatgtaccagaacagaacacatccacataagtcttgtggatgcaaagacccacatgtcttcacgtatcatattgatacagggtgtgtggatcaagaagaaaaccttggtttgtggttcgcattgaaaattgcgagtgaaaatggtgtcgcaaatattgataacttagaaatcattgaagcacaaccactcacaggggaagcattagcacgtgtgaaaaaacgcgaacagaaatggaaaaaagaagtagcaaaaaaacggttagaaacagagagagctgtacaagcagcgcaaggtgcgattcagcccctcttcacaaacgcgcagtacaatcgtttacaatttgaaacgttgttcccgcaaattgtccgtgcagagaagctcgtacaacagatcccatatgtgtaccatccattcttgagtgaggcactgctagccgtaccaggtatgaattttgatattgtacaacaactctctgccttggttgatagagcacgaggattatatgacctacgaaatctcgtacaaaacggtacattcagtagcggcacaggaaattggcacgtgacagatggcataacgacacatccagaaggaaatacatccgtactcgtcctatcggaatggaatcatgaagcgtcccagcaattacgtatcgatccagatcgagggtatgtgttacgtgtaacagcccgaaaagagggggctggaaaaggtacggtgacgatgagtgattgtgcagactatacagaaacattgacctttacatcttgtgattacaatacgatcggtacccaaacgatgccaggtggtacgttatcgggatttgtgacaaagacgctggaaatcttcccagatacagatcacatccgtattgatatcggtgaaaccgaaggtatgttcaaagtagaaagtgtggaactgatttgtatggaacagatggaggaccacttatatgatatggcggacaacttagaaaaagagatgcgatatctgcaatcatccaatcttccgattccttgcgctcctggaagttcaacagctgtaggtgatatgaattgtcagtgtgaaaaactagggcacgactcttatgaaaataaactaaaacattattgcaagtgtaaggattttgatacagatagacctgtgtatagagaaagttccgtggcttgcataaataatgttaattttaacactagggaaacaaatgttttgttagatgtaaatggtaaccctgtgttgagcggaagagattattatttacttaatcgctataccgagaataaaggaggaggagctacccaggtcagttggtggaggccatcgattgatgaatatcttggaacgcaagcacaaggtgaagagccttttaacacaaaatttatgtttttccgtgaaactatgggttatggaaatactcttcctttaaacagccgactcttaatacacgtacctgagaacccgaagtggtacgcaatagattgtacattcggggtttgtcttgctgcgagaactaatgcctatagcgaactatggactcctctgacaagtagtacatcactacctggtacttttcagtttcagaattatggtagcagtcaatttctcggaagtgatggaccaaatacttggctgtatgctaataaatctatattaggggaaattaattttgaaattgttcccgtt

SEQ ID NO: 37 - DNA, 3825 bp, Bacillus thuringiensis
atgaacctaaatgataacaagaatgaatttgaaatattggatagtggaaatttgtcttatcaaccaaggtatccattagcgaatgttccaggttatgaactgcaaaatatgggttataaaggatggagggatatgtgtccagatgcaaaacgacagcttctcggacaggtaggaatcagcccatatgatgatacggaaacgctgggaaaggtattagcgataacgacggggatagttgctgcactagcaggtgtggctgctactgcgtttccaccattagcagccgtgtcaggcgtattcggaattatttctatgattttggatgtattgtggccagaatctgattcgcaagtcgtatgggggcaattcgccggtgcagcagaagcgctggtaggtcgtagaatttcagatgagataaaaaagtcggccgacattcaattaagaattgcacagtcaagattaaaagattatcaacaagcatcctgtaatttacaaagacatcctaacaacgaagtgtataaggagttaataagagacgcatttgatgatgctgatgatgcattgaaagacaccataaaaatctttagtagagaaggttatgaactcctactgctattaaattacgtgcaggtagccaatcttcatttacttttgttaaaagatgttgtacgatttggagttggttggggatttccacagcaaagggtggagcaatattattcgaatccgacaaacctaggtagcccaggcatggtacaattattagcagaatacacaaaccatagtacctcttttttttggcaaggggtaagggagaaagaagaacagacaagggattactattggaatcaggagaagtacgatggttatcgtagcgatatgacgatgatggtgttagatatgattgcaatttggccaacatatgatccacgtaggtatccatatgctacagaagtacaactcacgcgaaatgtatattcaactgtaattggtgctcaatttaatcaaccgcagaatgggtggtatatgatgcctatagagtacacatgggacgcgcctcctagattagttcggtggatccaggaattcaatggttatacgtggaagaatgtctcaagtcttgctcaatacgccgggacaaaaataaactataagtacactacgggcgggagtactttttgggaaagtagaggaataattccatctgatggtgatggaagagtttggagcacgtattacctatactctaattttgtaaaagctcggcgcgtaggtggcggtgtttatcctaaatatgaattagccataatggatatggtttttcctgattccggaggaggctatttcacttttggaggaggctcagctccatcctactttgagacttattatgcgcctccgtgtgaaaatcgacctataaacgcgaacaatcctgatgtttgtacgccaaatgaatggttgaatgctcctactggggcttgtctttcaaaaggcttaaagagtcatatgttagcggacgttatcccagggcattggcttatagactctagtgtagcagataaaccatttataagtacttttgcttttgcatggcggtctacattgtgcgaggacttcaatacggtacaaccagacaagattggccaattccccgcagttaaggccaattggttaagcaatgatggtgctcgcgtggtgaggagttctggtaatacagggggagatttagtaagactcaatggggcagcagtacttaaaatggatgtgcaattctcagaacgtcgcatatatatcatacgaattcgttatgcaactattgcagatgattttggtttaaatgtcgttgtacgaaacaatggggatatatataatgatagtacaatattccggctcaatccaacatcaaataattcgacaactcagtggacgtttgaaaattatggatatcaagatgtgggtagtttatatccaaacccagacttggggttttacaatgtttcggtgtctacccagggtgccttagatagccatatggacatcgacaaaattgaattcattccaatagaagaatctttggaggaatatctagcaaatcaagatatagaaaaggcaagcaaggccgtgaatgccttgtttacaagtgatgcgaaaaatgctcttaaattgaacatcacagattacgcagtggatcaagctgcccgtttggtagaatgtgtatcgaaggaattctatgctcaagaaaaaataatcctactcgatcaagtgaaatttgcaaaacgactcagtcgaacacgcaatctattaaactatggagactttgaatcgccagattggtcgggagagaatggatggaaaacaagtagccatgtccatgtggcatctgataatccaatctttaaagggcgctatctccacatgccaggtgcgaattattctcgttttgataataaggtatttcctacgtatgtatatcaaaagatagatgaatcgaaattaaaaccgtatacacggtaccttgtacgtgggtttgtcggaaatagtaaagacctagaattactggtagaacgatatggaaaagatgtccatgtggaaatggatgtaccaaatgatattcagtatacgttaccaatgaatgactgtggtggctttgatcgatgtcaaccagtatcccatcaaacagcatcccctcacacatgcacatgtaaagataccactgtagcgcatacagactgtcagtgtaaagataagggaaatcgcacctcaacgggcatgtatacgaatggacatcattctcacaaatcatgtggatgcaaaggcccacatgtcttctcgtaccatattgatacaggatgtgtggaccaggaagaaaatcttggtttgtggttcgcgttaaaagttgcaagcgaaaatggtgtcgcaaacattgataacttagaaatcatcgaagcacaaccactcacaggggaagcgttagcccgcgtgaaaaaacgcgaacagaaatggaaacaggaaatggcgcaaaaacgtttacaaacggacaaagccgtacaagcagcgcaaggtgcgattcagcccctattcacaaacgcgcagtacaatcgtttacaatttgaaacattgttcccgcaaattgtcaatgcggagatgttggtacaacagattccgtatatgtaccatccattcttgagcggggcattgccaactgtaccaggtatgaattttgaaatcattcaacgactattggcggtgaccggaaatgcccgtggattatacgagcaacgaaatctcgtgcgtaatggtacattcagctccggtacaggaaactggcacgtaacagaaggcgtaaaagtgcagccacttcaaaatacatccgtactcgttctatcagagtggaatcaggaagcgtcccagcaattacacattgatccagatcgcggatatgtattacgtgtcacagcgcgaaaagaaggcggaggaaaagggactgtaacaatgagtgactgtgcagcctatacagagacactgacctttacatcatgtgactttaacacgtctggttcccaaacgatgacaagtggtacattatctgggtttgtgacgaagacgttggagattttcccagatactgatcgtattcgaattgatatgggggaaaccgaaggaacgtttcagattgaaagtgtggaactcatttgtatggaacagatggaagatgacttatatgatatggcgggaaacttagaggaagagatgctggatctagggatagaaaacatcaatgcagttacgaataagatgtgcttctcatgggatattcagtgtcct

SEQ ID NO: 38 - DNA, 3912 bp, Bacillus thuringiensis
ttgcgtaatctaatcgatgttccagtttttcttgaccaagttataaagaagatacggggaggtttatacatgaacataaatgataacaagaatgaatatgaaatattggatagtggaaatttgtcttatcagccaaggtatcctcttgcgcgagcaccaggttctgaatgccaaaaaccaaatgccaaagatggaatatacacacctgtgggcagagtggatacagcccttcaaaatatcgatatagggttatctattcgtacagcgctttctatcttacaaatgcttctatctgtaagttttccagcactaggaagagccgctggactaataaatattatttttggatttctgtggggaacacttgctggtcaatccgtttgggaaaagtttatgagagcagtagagtctcttgtaaatcaaaaaattacagatgctgtcagagtgaaagccctttcggaattagaaggtgtacaaaatgctttagaattatatcaagaggcagccgatgattggaatgaaaatccaactgatgtatctaataaagagcgtgttagaagacagtttacatctacgaatacaacaatcgagtatgctatgccatcatttcgagttccaacttttgaagtaccgttgttaactgtgtatgcacaagcggctaatttacatttacaattgttacgggatgccgttaagtttggaaacgaatggggtatgccttctgaggaagtagaggatatgtataatagattaacaaggcgtacggcagagtatacagatcactgtgtagctacctatgataaaggtttaaaggaagcttatgacttagcaccgaaccccacagattacaataaatacccttatctcaatccatactctaaagatccgatttatggtaagtattacacagctccagttgattggaatctatttaatgactatcgaagagatatgactcttatggtgctagacattgtggcagtatggccaacctacaatccgagaatctatacaaacccaaatggcgtacaagtagaactctcaagagaagtatatagcacagtatatggaagaggaggtagtaataattcatcttttgatgcaatcgaatctcaaattgtcagaccacctcatttagtgacagaactaaccaatctaaaaattgagcagggtgctactctagatatggaacagatacaatatcctaagtatatgaaagttacgaatacgcttcattatgtagggagttcttccacatgggagcaaagctcttctgctattcctattagaccaattacgcagattcatactatcccagccaataatataggtaatctttccttatctcaattagatgtaccttaccgattttctttctataacaaagatgatgctttgattgctgcagttggagctgaattccctccaaacactgtaacctggaacgggatacctaaagccgaagatagtaatcaaaatagtcatcatttatcttatgttggtgccttaggtacacaatcttcagctgggtttccttggacatatccgacggagcttttaggagaatggggatttggttggttgcataacagtttaacaccaactaacgagatactaagtgacaaaatcactcaaattccagcggtgaagggatatttgctagaacgaggcgctaaagttgtaaaagggcctggtagcacaggaggagatttaatacagttacctggtgcatcccaaggaagaattactattaatataagcaacgcattccaaaagagttttatggtgcgtattcgatatgctgctactgctgatggtcagttaaaatttggtaggatttccagtgatggaggtattcattcgacgagtacaaaatacgttactaccggtgcgaatgaaaacgtaaattcgttaacgtacaatcggtttaaatatacggatgtttatggagcaatggctagtaatatttatagtggcatagtacttataaacgaaatgggtggatcaatctacatcgacaaaatcgaattcattccaataaaaggatccttagaagtctttgaagcggaacaggatttagaaaatgcaagaaaggccgtgaatgccttgtttacaggtgctgcaaaagatgtcctgaaattgaatgtgacggattatgcagtcgatcaagcttccaatcttgtcgaatgtgtatcggatgaattccatgcccaagaaaaaatgatcctactggaccaagtcaagtttgcgaaacgtttgagtcaagcacgaaacctcttaaactatggggattttgaatcttcagattggtcaggagaaaatggatggagaaccagtcatcacgtttctgtcagatcggataatccaacctttaaagggcactatctccacatgccaggtgcgatgagccctcaattctctcacaatatctacccaacgtatgcgtatcaaaaagtggatgaatcaaaattaaaatcttatacacgataccttgtgcgtggatttgttggcaatagtaaagacctagaattactggtagaacgatatggaaaagacgtacatgtggaaatggatgtaccaaatgatattcggtatacgttaccaatgaatgaatgtggtggctttgatcgatgtaaaccagcatcacatcaaacaggatctcctcatacgtacacatgtaaggataccgctgtagcgcatacagattgtcaatgcaaagacaaggaaaatcgtacttcaacgaacatgtatacaaatgtgccaacagatagtgcggtatatatgaatggatcccatacgcaccaatcgtgtggctgtaagaacaagaacagtgacaggtatcagagcggaacacacccacagaagtcttgtggatgtaaagacccacatgtcttctcgtaccacattgacacaggatgtgtggatcaggaagaaaatcttggtttgtggttcgcgttaaaaattgcaagcgaaaatggtgtcgcaaacattgataacttagaaatcatcgaagcacaaccactcacaggggaagcgttagcccgcgtgaaaaaacgagaacagaaatggaaacaggaaatggcgcaaaaacgtttccaaacggacaaagccgtacaagcagcgcaaactgcgatgcaagctctattcacaaacgcgcagtacaatcgtttgaaatttgaaacgctgttcccgcaaattgtcaatgcggagatgttggtacaacagattccgtatatgtaccatccattcttgagcggggcattgccaactgtaccaggtatgaattttgaaatcattcaacgactattggcggtgaccggaaatgcccgtggattatacgagcaacgaaatcacgtgcgtaatggtacattcagctccggtacaggaagctggcacgtgacagaaggagtagaggtgcagccacttcaaaacacatctgtgcttgttctatcagaatggagtcatgaagcgtcccagcaggtacggattgatccggatcgcggatatgtgttacgtgtaacagcccgaaaagaaggtgcagggaaaggtactgtgacgatgagtgactgtgcagactatacagagacactgacctttacatcttgtgactacaatacggtcggtacccaaacgatgacaggtggtacattatcgggatttgtgaccaaaacgctggaaatcttcccagagacagatcgtattcgcattgacatcggagaaacagaaggtacgtttaagattgaaagtgtggaactcatttgtatggaacagatggaagaccacttatatgatatggcaggaaacttagaggaagagatgctggatctgcagtcagctcgttccggtagtggtacgaaacttataccaccattaacatttagtgattgctatacgaataatgagtattgctac

SEQ ID NO: 39 - DNA, 3849 bp, Bacillus thuringiensis
atgaatcaatatgataataaaaatgaatatgaaatcatatgtagcgatggcatatacggtcagccaaggtatccttttacaaaagcaccaggctctgaattacaacagatgaattataaaaattggctgagtagatgccaaaatgaaaacataggattcactcctgaagaggaagctgtaaaaacggcacttattatcagtacaggacttgcatgggcgctccttgcagtgattccaggtattaatgttggagtaacagtaggagcaggagcagctgcagcagcgggagttctcaacgtattgattccctttctttttccagatcagacggtggacaatcaacctgcgcctccacaatatacgcagaaagagttaatgaaatctgtagaagctctgactagaaaagaaattcaggagagtaaacgagtggatgcgctcgcaagatgggaaggaatccaaactatgggtcgtgattattatgcagcactttgcgcactatcaaaagacccagacaatgaggagaaaaaatttgcagtgagagattcttttgatgacgtggaagatcagttgaaactctcaataccatattttagagcacagggctttgaaattcaaatgttagccatgtatgcacaagctgctaatttacatttgacaattttacgagatgttgtcagatacggaaagggctggggattttcgcaagaacggattgatgaatattatgacagtcaaggtagtgcaaggaatccaggattattacaactattatccgtgtatacaaatcattgcgtaaattggtataatgtaggtttatctcaagaatatggaactggtaattggaacagattcaatgattttcgtaggaatatgaccataatggtccttgatattgtagcagcatggccaacatataatccgagattatatccgctacccacagaatcagaactgacacgaactgtatatacagaccttttaggaaatacaggaggaacagggcttactacagagggttctcagcctattggtattattgaagaaaatgttacagttcgcccacaattgtttaggtggttgcggagtttggatatgggcgcgatagacggcgttcaaaccactgtattaaaaggagggcaacaaaaattcgaaacaacaggatcttcaacaataattgatgaaggctggaagggagatatagaaataggaatgaagttccaagagcacaattccttatattggcctatgtcacccgtagcgactaaatttttcaagggagccgtaacagggttcgcctttggtttaattgatctagggcgatacagatatctttttttctttatggcttctgtacaccttccaccaggaggttcatacttctcaggtctaccatgtaggccagaagggaatagcgactgtgaggatccttgtagcccggattgtataaaagagacactacctggttcacaggcaatttgtattgatccgaatttcttgtctagccatcgactttcaaatgtgggtttcggcatgttaactgcaaacgatcctcagtttgtcacccctggaacaaaatttgcggcctattttagctacggatggactcatgcaagcgcaaagtcaggcaatgtgatagctcgagaaaagattacacaaattccagcagtgaaggggtataaattccatcaaagtgctcgtgttataaaagggcctggtagtactggtggagatttagtaaagctagacgtaaatggtggattttatatacaggtggtaaccgctcgaagtgaaacagtatccggctatacaataagacttcgttatgcgagtaaggcagaaatcccactattatttcggattacagacccagattatggtaattcaatgcaaatacccgatcttccagctacaacttctgatgataatcttacctatacagcttttaactactacaacatggggattcggctagaggcttcagcaacttcgaaagagattataatattcatgcagaatttgagtgctgaggatgctctcatcctcgataaaatcgaattcattccaatggaagaatctttagaagaatatgaagcgaatcaaggtttagaaaaggcaagaaaggcagtgaatgccttgtttacgagtgatgcaaagaatgccttacagttgaatgtcacagattacgcagtggatcaaactgttaatttagtagaatgtgtatcagatgaattccatgcacaagaaaaaatgatcctactggatcaagtgaaattcgcgaaacgactgagtcacacacggaatctactgaactatggtgattttgaatccccagattggtctggtgaaaatggatggaaaacaagtcctcatgtccatgttgcggcggataatccaatctttaaagggcgatacctccacatgccaggtgcgacaagctcccagttttctggtaatgtatatccaacttatatctatcaaaaggtagatgaatcaaaattaaaatcgtatacacgatacctggtacgcgggtttgtgggaaatagtaaggacttagaattactcgtggaacgatacggaaaagatgtacatgtagaaatggatataccaaatgacattcaatattctttaccgatgaatgaatgcggtggctttgatcgatgccgacctgcatcgtatccaacaagcccttctcacacatgtacatgtaaggataccgcttccatgcatatggattgtcagtgtaaagacaaagtgaatcgtccttcggccgacatgtatacaaatataccgaccggtagtacaggatatgcgaatggattccatgcccacaaatcctgtggctgtaagaacaatgacatgtatccgaacggcaaacatccacataagtcttgcggatgccaagacccacatgtcttcacgtaccatattgacacaggatgcgtgaatcaagaagaaaacgtaggtctattctttgctttaaaaattgcaagcgaaaatggtgtcgcaaacattgataacttagaaatcattgaagcacagccactcacaggggaagcattggctcgtgtgaaaaaacgagaacacaaatggaaacaagaaatggtacaaaaacgtttagaaacagagagagctgtacaagcagcgcaaggtgcgattcagcccctattcacaaacgcacaatacaatcgcctaaaatttgaaacgctgttctcgcaaattgtccatgcagagaaactcgtacaacagatcccatatgtgtaccatccattcttgagcggggtccttccagctgtaccaggcatgaattttgaaatcgttcaacacctgttggcagtgatcggcaatgcccgtgcattatatgagaaacggaatctcgtgcgtaatggtacattcagctccggtacaggaagctggcacgtgacagaaggtgtaaaggtgcatccacttcaaaatacgtctgtgcttgtcctatccgaatggaatcatgaagcgtcccagcaggtacgtatcgatccagatcaggggtatgtgttacgggtcacagcccgaaaagagggtgctggaaaaggtacagtgacgatgagtgactgcgcagcatatacagagacactgacctttacatcttgtgactataacacggttggttcccaaacgatgacaggtggtacgttatccggatttgtgaccaaaacgttggaaatcttcccagacacagatcgtcttcgcatcgatattggggaaaccgaaggtacgttcaaagtagaaagtgtagaactgatttgtatggaacaaatggagggccatttatatgatatggcaggaaacttagaagaagtacagaatctaaca

SEQ ID NO: 40 - DNA, 2406 bp, Bacillus thuringiensis
atgactaaaaaccacaagaaaatattatctatgacattagttacaagtatgcttgctggaacgtacattccaactgcttatacagcatttgcagaaacagaacaaaaggaggggtcacaagaaaatcaaacaggccctataaacaaaggctcccttccattagattcatatggattgtttgaaaacccttataagggagtaacttttgaccaatttatgaatgcatttaataacaatacgtggaatcctctattagttgatatcaaaaataaagggaatgctggttcaggtacgctaacttttttaaagggtataatgggaaccggattatccttgttaccaccaccagctagtcttttagggagtgtttggaatgtgtttatgccgactacggctactaatggaacagacatgtggaagcaattagaaacatatattgaggaaaaaatagatggaaaaataaaagagtatcataaatatcttatgggtgctgaatttaatggggcaatgacagcaataaaagagtatcaacgtgttttgcaaatctataatgatagtaaaaatagcctagcaagagtagaagaacctggcacgccagtgattgaagctgtccgagcagcagataggaagctaaaagagtttattgctattattcaaacacctgaaaacaaagcagactcggtatatcaacaaataacggctccaatatttgtgcaagccgccaatgctcatctcttattacagagagatataattttatatggtaatgaatggggaatggataaaggtcaatgggaaggatatcaagctaaccagaaaaaactgattcaagaatatacaaattatgctatgcaagtatataatgatggactggaaaaaagaaaaaaagaagctgagcagattaatacccttgaaaaatatcgaaataccgatagatggaatcatatcaataaatatgtaagagaatataccttaagtgttttagactttgtagaattgttcccgtatactgaccctagtaaatattccagaggtaccattcagaacaattctagacagatatattctgatattggggggaaaattcaaccaaaagaaagaacatggcaagatatccaaaaaattcttgattctcaagaatataaaggcgatttaaaaaggctcgacatacgatcggcagaccgaattgacgcgattagagcacattactcagagcgtttgttcgatgcaacaccatgggctactacgggatggattggaaatacgactggtggaaatttaaaagaaattccatcctatgatgaccccttaaccaaagttacagtaggatcagaaatcacgcctttttatctccacttggaccatgagagtggaaaaacgtactctcgatttggttcaaccctttctggaaagggaacagcatctacttttgaatatcctggtcaaaagatctctcttgttcacgcctttaatagaagtacgcagccaggatttgatggtattgacgcgatcgtattcgggtttagtaataaaaatctgagtcttaaatatcaattggcgacaaatatgataacgacaataccagctgaaatgtataatttaggaagtggttttggaactcaagttgagcctatacatgcgcaacaaaaggcaatgaagacagatactcttaattcctatttaaggtatgatgtaaagactcctaaaacacaaaaatataaaattaaatacagggtttcagctaatgaatcctctaaaattcgacttttatacaataataaccttgttgaggagacttctattcctgttataaataatattgctgcagacacaataaaaggagaatatggctattataagactatagagggaccaacagttgagataaaagctggagaagcagtttcaaaccgactacaaattgaaaatggacaagggaaattttctttagatcacattgagttagaaccgctggaatctgatgaagtagttgcgcaagataacttcgatgatcgacgtttaaattggaataatataaagagcattgtaactgaaggtatcacaggtaacgctggtacaattggtcctaatggagatacttggacatatattaataatcaattagtagggaattctagatatacccttagtatgaaagtaaaattaaactccaatgatgcaaatgtacgacaaaaagtaacggtatttacggataataagaatcatcaaagagtgacaaaaacagtcgaactgaaaggaggggcagggttccaagagataaagctagaatttgctactgataaacttatgcatttagtaggtctagatactcacattgggattcagacttcaaatggaaattctgatgtattatttgatgatgttaaagttatcggtgcgaaaaaa

SEQ ID NO: 41 - DNA, 1722 bp, Bacillus thuringiensis
atgaagtataaaactcgaaaagatgcgaagcgcaaatacaaacaagcgtttcttgcaacagtagcaaccatgacattaggagtcagcacattggggaacaatacttcagcatttgccgctgaagaggataacatttcagtaatttcatcacacacactcaacgatgtagggatacaggtggagaagattattccagataaaactttaagagaaaagtttcttaagacattcgccactaaggacacaacgaaggtaggaattaatggagctttccaatttattaaagatgcccaaaaagatgttccaaattttaatgacacttttagaactctagcaatggcaagcacggagctcattccatatgcaggaatggttatttccccactaattggtttactgtggtcagaagaaggtggcgtttcagcacagataatggaaatgagaaaacaaattttgactctaatagaccaaaaatttgataacgaatatgtaaataatcttaaaacagatttcaagacactaaattcaaacatactaacactcgaaaaatcattgaattctaattctaatactaatgcggtgtattatgctggaaatgatatatatacaactcgtggtaactgggccaatcacattcaacactcatttgaatctcttatagatcgtgcttcgagtaaccatgaagtagcaagtttgcctctatacactaatcttgcagttgctcatataacgtttttaaaatacatgcatgagcatgcaaaaggacctaaattgaaatatgatgagcaaagcttacaacacttttttgataagggtaatcttgaggtaattacaaaaaaatatgcagaccatataaagaagacatatgatcagggtcttcaaacgttcaacaaagatcttaatgaactagatgaaaagattaaagaaagaactaatctattacagaccccagttaacggtcttgggaaagagctcaaactaaaaacattgaatacaaaaataaaagaattagaagataagcacctacaaacgaacaaacaaaatttcatcgccttgacatggggggattcaacattacaagcgatactacagggtgagtggaaactagataataacgcgttgtctttcattgataaaaaaggtgtaaagaaaaccgattggctgcaacttggtactaactggtattatctcaatcctgaaaaaagcgaaattaaaaactcggcaggcgatatattcaaatcaggggaaatggtaactggtaagattgacattaaaggtaaaacttattacttcaaacctggtacaggagaaatgaaaaccggatgggtgaaagatggggataagtggtattacttcagtcctaaaaacgacaataaaaactatgacggcaacacatttaacgaaggagaaatgatgactggatgggtgaaagtagctaatgaatactttttcttagccactgaaaaaggtaatcaaaacgataacaacgataaagaaaatgccgtaatatttaacaaaggagaaatgatgactggatggatatatgtgaaggacggaatagcaacaaaggaaagtaatagcggtggcgcatggtattacctaaatgacaaaccagaatatggcactataggtcatatgctccacgatattaaagcatcagttagaaacaaagaaggtaaatacattgagtataagttcggtgaagacggcaaaatgaaatgg

SEQ ID NO: 42 - DNA, 1560 bp, Bacillus thuringiensis
atgaaatacaaagatcgaacatctgtcaagcgtaaatacaaacaggcgctacttgcgacagtagcaacaatgacattcggagttagtacattaggaagcagtgcttctgtatttgctgccgaaaatgcagaagcactgcaagataccactgattcactaggtgctggtggtggtgcagatttagagcaacaatggaaggaaatggctaaagagttaggagaccaccattcaccaagtctgcaggcgaaaggggttgctgagctactttcaaagggagcattttccgtgtataaggatgcacattcaaataaaggaaattttaacaatacctttagaactctatcaatgggaatctcagaatactttccatatggaaaattggttatatctccactaataggtttactatggccggagaccgtatccactcaaaataaccagtttgaatcattaataaaccaaatgtcttcattaatggatcaaaaaattgaagatttcgaccttgccactattaaacgacagctagaggcgttaaaaaaggaaatgcaagtgttcgaaagattagtgaattccaaaattttgactgaaggtttttattcagcaggttctccagaggaaagcgcacgtactaaagctgcacatcttcaagcgacatttcatgaattgataagtctctgtcaaaaaaacaacctaagtgaagccgagctccctctgtacaccaagattgcaaatattcatttgctatttttagattttatggacaaaaattggaataaatccaaactacaaattgatcagaaaagctttgatgctttatatgcagatgatattaaaaatgctgctcaaaaatacgcccaacatatacatgacacatttatattaagtaaccaaaagattgataaaaagctgtcaaatatagcagaaggtagtaatcatcaaactaccctagaatggctaagaacaaaattggtaagtctaggtaatgacttagagcttaagaagcaaggtaagagtggttcttcgaatcgttccttggctgcagtacagcgtgattacaatgcttttgaagaaaaatatgataaatatagggatttattaaataaaaagagtacctatcaagaaagtacagttgatgatcctggattccatgcagcattaggtaaatggaaaaaagagagtacagaatggtatttcttagatatgcatggagaaaagcagacaggatgggctttaagctggaatagtaaatattattaccttagtactaaagacacagatagtaatactgatggcgacacatttaaaaaaggacaaatgtggactaagtggatgaaagatgctaatggaaattggtactattttagtcctactaccaaagatggctatcaagaaggacaaatgtggactgggtggatgaaagatgctaatggaaattggtactattttagtcctactaccgaagatggctatcaagaaggacaaatgatttcaggtaagacaataagtatttccggtaaagaatataattttgataccaatggcgtatgtacaaatcctaat

SEQ ID NO: 43 - DNA, 1050 bp, Bacillus thuringiensis
ttgatgtttatgccacttgttcctcaagaaagttttgaaaatgataaaaaaaatttaaatactcatgttttacattatagttcaaatcaacttgttgatataggtcaaggagatgtagtaaatgcacctttacctaaattatcaaataatcctattgatactccaccatcaacaggaacagctataacaaaaaatcctttaaatttacaagattatttaactttgactgtaacttctacaaatattaaaagtgctactgatgtacgtgatgcaataatcggaattctagcaagtttctttctttacaagaacaataatataccgagcccatttcactcaatagtagatgagtctaatctaaacaaattaatattttatgattcagaacgtaataattttcttgatttaggaagtagtaatccagctcctccaggtgaaaataatatttgtttctatatatcaattccttcacacattgttaaacgagatttattaaatgaatcctatgttatacgtacaacacaatataaatatctagatggaagtttacaagatcgtactatttctactgattggaaaaaaacgattacaactggatcatctaaaactactacatggggattaacagcaacacaaggaatggaattaagttggacagaaggcggatttccacttccagctagtgcagaacaaaaaataacgctttcattagaagaatcatatggacaaagtaatgaatattcaacagaaacttctattgaaaaaaattatcattttgataaaccaggatctgactataaatatgatcaatatcgttatgctatttatcaattatctacaagttataaattaaaagatggttgtactttaatgaatgatttacaaaatttaaatacagtctttggaccaggtaagtttaatgctaatggcaaatattttactttaaaattcaacatatcagatgttttagtaccagaaaacacaatatatgctacacaaacaccagaccctactccatcatctttaagtttaattcaaaaaatgaatatt

SEQ ID NO: 44 - DNA, 1023 bp, Bacillus thuringiensis
ttgggaatatataatgaacatgaaaattattttataaatcaagataagacaattttattttatgataaaacaagtcctaattacttaatagaacaatctaaaaatatacttgaacatggatttatacctgaattatctaaagatccttttgataaaattcctttaacaagtaaatctatacattcatctcaaataaatgcaacagattttttaacattaacattacgatcagctcgtgattatcctaaagggattacgaattctttatggaatgaattgttgttaatttgtcgtaaattagtagcatatttttttcattctaatatggatatccctatattatataattcatatggtatagaaatagatttagatcgtataatgattgctaaaccattaaatacgatttttaaaaatgaaattttattatatatttctttaccaaataaatatttaaagcattcatcagaaaatattcaattaatgaaatatacttcgtataagctattagatagtggattacaagatgctaaaatggaaacacattggtctcaatttataactagcggtttaaatttaaatacactgtgtgaatttttaactgttatcggtttcgaaataactaacatttcggaaaaaacagtaatccctacctctattgaacaaaaaataagaaattacctaaattatatatttaatacaaataatacatatattactaatcaaataaagagaaaaagttatattttaaaatcagttagttctaactatatatatgataaatatgcctatgcaatttatcaattaactacagaatataaattaatagtgaaaaataatcttcaaaatatattaactaaaataaatacggccttcaaacaagaaatattatttcagcaacatttcggaaatataaaactagaaatacctcaacaatatatagtagaagcagataatttatgtataattcgaacaccggatccgatagtatctaaagaatatcattcaatacaaataatgata

SEQ ID NO: 45 - DNA, 993 bp, Bacillus thuringiensis
atggaaaaatccccaaatacaaatttcttatcgtgtgttgtaatcaaaggaggaattagaatggcaattacagatgttcaatcttctgcagccgattttatgaattgggctataccatactacctcaacggaactgtgacggcgcagcaattctacccatatgtaattaagaaccctattgctgtgccagaacagctattctttgtaacaatccctgtacaaaaagtagcatcggtacaagtcatagaaaataatacgagtttgacacaatcgcagactttgaagttttccgaaaaagcaatcgaaacaacaacctcgtctactacagagggatataaagttgggagtgggataacatcaacaagcaaatttagctatactactaaaatttttggatcttccattggtttagaacaaactttcacggttaacgtcaatagcgagtataatcatagttctaccgaaacaacaactcagacaacagaacgcttatggaaagtaacgcaacctgtaagcgttctgccgtatacaaggatagtcgcaacactcacgattatgggaggtgaggtcgaaatcccgatgacattaaatgcaaatctcttggggcaaggtctagatacagaatattattgtggagcggatttctctagtcctgattatcctaacgcttggcagccttttatggctagtaatctttatgatacaagttggccaaataaaccagcttcctttgcagggggaaatggtaacgaacttattctaaaaggggcctccattaccacgaatggtccgagtttatattctactgttcattttgaacaaacacctttacctggatatgaaaggctctctgaacctaaaagctggtattcgaacgaagtagtattaagagatggtacgatgataacaatacctgacttagatcctgcaacaggaagagtacttccttcaaaaatgccagagccgatactagcatcttcaagaataaatgac

SEQ ID NO: 46 - DNA, 945 bp, Bacillus thuringiensis
atggcaattacagatattcgttcggcttcagaagattatttgcgttggcacgcccaatattattgggggggagcaacgttgcagactatgggcttctatccatatttagttcagaatcctattgctgtgccagatcagacagtatttgaagtagtccctgtacaaaaaatctcggctgtgcaagtcctaacaaatgattcagatcaggaacaaacacaaatcgttgatttttccgaaaaaataatcgaaacaactacctcgactactacagagggatataaaatcgggagcggtataacatcaacaagcaaattcggctatagtcttaaaattcttagcactaccactggttttgaccaaacttttacgcttaacaccactagcgagtataatcatagttctaccgaaacaacaactcagacaacagaacgattatgggagttgacacaacctgtacgtgttgcaccgcgttcacaggtaatctcaacactcactgtttttggggggaaagccgaaatccctatgacattaaatgcaaatctcttagggcaaggtgtatcaaatggagctcctgaagtgtatagtgacctgactttacgtaaaactgatggtagtacgtggtataactgggtttatgcttctcaaatgtatgatcttgcttggacaggtaaaccagtttcctttgcaggatatactggtcactcacttattctaaaaggagccgccgttaccacgacagggccatgtttatattctactgttcgttttgacgaaactcctttacctggatatgaaaaggactctaaacctcgaagttggtattcgaatgaagtattattaagagaccgtacgataataacaatacctgacctagatccgaaaactggaaggccgcttcctccaaagggaccagagccgatactagtatcttcaagaataaatgac

SEQ ID NO: 47 - DNA, 933 bp, Bacillus thuringiensis
atgataatgattacaaatatagaacagtctacgataaattacatgatatggtatgcaacacactatcttcatgcaaatccgaatacattctacaatataggtctctacccctacgagattcataatttgagtatcgtcccaaaattcaaccgtatcactgtaaatccttcccaaaaagatacagtgattcaaacaatagaaaataatacagacgtagaacaacatcgaataatcgaattttatgaaaaaacaaccgaaaatattactaaccgtactacagcaggatattcaatctatgaagggataaaatcaacttttacatgtaatattcaggtcaattttataatatcaggtggtttagaagagtctcttgaaattccagttcattccgaatgtaaatgctatgaaaccgaaacaacgaacaccacatgtagcaagctatggaaagtaaagcagaatgtaatgatccctccacattcaagaataaatgcgagtcttataattatgggaacgaacataaaaattccaatgcaattatcggctaacataaaaggaactcacgtacacaataacaaaagtaattatttttcctcattatcctttcaacaacacgatggttcaaaagtacgggcccaattttgtgctagcaatttaagtcaagatgcttggcctaacaaacctgcaagctttcgttctccaggaccatatagttctcttaatttaaaaggtgatgcaattactacgattgaacccggcctatatgccatgattagatttgaacaattaccaataaacggatactcacgagagggaaaaatttggtattcagatcaaatcatattaagagatggaagagagatacgattaccgaatttcgatttattaactggaaaggcaagttgcattgacgttgatatgacgattataggtaat

SEQ ID NO: 48 - DNA, 3010 bp, Bacillus thuringiensis
atctctaacaagttgtcacacaatgaacaaacgtagtgtatatacaaacatattcgttctttccagacggttctctctacaatcaaacatatattttatgttctctatatattcttcttcataccgtacgagaaaaatcattttctactaaaatcgatagataagtaggaaatgataggatcaaataattagtacaaattgcaatacaagttagcggagtctcgcatctctcgctcttttccgttccatcatatagctaaatcaaatttgaaaggaggtgaaaggatgaacaaagacgaatatattcaagctgattttaagtcagtaaatcatgaatctcagacgcagtcattaggacaacattctccgcagccaccccatcaaagttgtgcaggtgaggtcaatcatagcgttcccttctgctgtgtggtcaacgtcccacatggttttcactatgtgccaaatgggaagcaggaggtagcctatagtttggattgcctttcgattgtcgaagaaacttgcaaaaaaacgattgtggtagaggactgtggtccagtagaagtaaaacttcgtctgattaaagcggtaggatgtattcctattatcgcgaatgcatcagtaaagggcgattgtggcacatactgtgaagattcatcacatggtcatcatatcgtaaaaataagttgttcagacacgatttgtgttgataatatactgaaatgtagtatcgattgtgtaccagattatgaaattaattgtcataatgtagtgctttccaattttaaggtgacgccactacaagagtgtgggtgtcagatgcttcaatttacgggaacgattgaattcaagaacaacctgtagtgaggctactcctagatgaatggagaatcgaaacaaaattattacgaaaatccatgtctcaaacaataagattcaccttgaatatgtaaagaaggagtgaaaaaacatggtgagaatatatcctcgcttgaatgagctaatcagagaggccgctagaaaatgggcagaaaataaccaatttcgatttttaaggtctactttgttagatcctgatacaaatgatgaaactgttgttatgaataccacttttacagagataggatctccagaagagtgtatggacttagaaccccttcaaatcaaacaatcttttacaaataatacagatcaacaaacgacagaaatattcagagatgttgtatatgtagaagacgatttcacatgggaaaatgagtatgaatttaatatttctgaactcaaacttttaacgatcccgcgtgtacctaagttagcctataaagatattaatcccggattccaagtcgatttatttggtccgaaccgggtattttctaccaaaatgagagaaatgagaccgcttcgagcggaagtatttttagaaccacatagtagcgtcaatctgaaagcaaaagtggagaggcaacaattttctcaagaataccaactcgagttatcgatacaaggagatgttgttgtgactactgaaaggacaacgggtgaatctgaggaatattatgtgtcactaagagatttaataccatttttcgttttacctaataacttcactttggaagggcaagcactcgtatttcgtgaaaaaggaaaattcacaggcatattatatcgagcaatccatctctatgtaacacaaaccctttacaatgagaggaaaattctagagtatgaaattcctttattaccccctttagatgatcttagatctcgacttgtagaagcaataggggcaagaaggttatcaccacaagaagatgaatttactgttgtttcctctacttcacaaaccgtaccacctaaagaacaggaccagtgtggatgttcttcctgtctgtcttcacaatcaaatacgaatctatatacagaccaataaaaggagaggatacaaatgaaaacctgtacaaataatagcaatccaaggaatactgttttattagagttggatgattatataacacacgttgttaaggaaaatgtagtactgggacctccagatctagtaggaagaaaaatgggttacccaccaggtttaggttcttggagaatggattcatcgtatttcccgactcctacttcgagtcaagtgcctggtcctccttgtaacactaccttcacttgtaggtactatccttctcctgcttggggttataatacaaatagcatgattgcggaaggtataaacaaagttatagaagcagaaactgtagctctagcacaacctattattatggatattcataattttagcaataatacaaatgttcaacaaacctattacactcctgaatattcagaagtaacaaccacaactgtaacaaattcaacaacgtctggaatcaaatctggaacaaaaatatcggcatctgttaaattcaaaatactaaaggctgagtttggagtgaatacagaagtaagttcagagtataatttcagtactacacaaacaataacaacaacgacatctcgaactgtcactttcaaagcacagcctgtagtagttgcacctcatactacggtgcaggtgactgtactattaaatcgagtagtgtatcaaaatgaagctgttccaattgaggctgatttatcaggaagaatttatagtgatgacggtagtgtaggcttggatttctatcctacctttgagtttttcaatcgttgttgtggaacagctgagtgctgtaagttaccagactctcttaaaattggttctaataataaagttcgttttactggaataggatactttcagtcagatgtaccatctaataattttcagataacgactgatattattgatgatgcaactggtgcaactatttcacgcgatgtacaatttgtcccggcgactttcgggcccattttaggaacaacaacttcaacttcataaaaaaggaaacatacaatagattgtaacccccttttttcgataagaatttcaaatatgaaatagatc

SEQ ID NO: 49 - DNA, 3080 bp, Bacillus thuringiensis
gtgtgggccatagaattggtagagggaattgtctagttgagataggtatctaaacgttctacttctttttttcttgacatacatttatgctgtatgtggaacatacacgaaaatgtatggaatcatagggaattctatcgaaatatttggtacagaaaaacaagggaaataccgattatggcgggaatattttgtatcagaacgataaattaattatgaaaggaggtgaagtgattgaatccaggagaatgtgaaaaaaatcatcacatgatacatacacctcaatcccatccctcttatttagaaggtgtatcgcagtctgccgctaccttagaagatacagagcaaatcaatacgcatgtatctttctgttgcatggtacagataccggatgggtttgtgcatgtcccaaaataaaaaaccaaggattgcttatagtgtctctccgttatctgtcatacaagaaacctgtcggaaaaatattgtggtggatcactgtggaccagtggacattacattgaaccttctcaaagttgtaggaagcatgccttatattgtgagtgcgacagtacaaggagaatatggaaaaaaagatggagagacaacacaatcagagaatcggattgccctttcgtatacggggcatatccctatcaattgcgtattaaaattaagcgtagaaaatctacctgaatatcacatagaagaacaaaatgttgctatttcgagtttacaagtcatacctgttcaggaccaaggatcaaactttcttcgctttacaggaacagtaggttttcagaatgtgccgcgttcatgaggaaaaaacaatagatttcataaatgaggagtgaaacaatatggtgagagactatcctgattttgatgggatgctaaggaaagctgctcgaaagtgggcagaagcaaacagattgacattccaagatatttcgtatgcggatcctttaaccaattcggatacaatcagtctaaatgtcaaattcaaagatatcggatgcccagaagaatgtgtcgaattagaaagaataagcgtctcacaagcttttacgaataatacggggcaacaacaaaaagaaacatttaaaactacaacatatgtagaagatgagtatacttgggagaatgactatcattttgtgcttccaggacaaaacttccttatcatgccccgtcttcctcggtcagctcatagggatattaatccaggtttcctcgtgaatttctttggtgaaaatcaacaatttcatactaaaatgagagaactacgcccaattgaaggtgaagtgtttttagaaccatctagcagtgcaacgattcaactgcaagtggaaaaacaatatatttctcaaccgtatgaaattgaattatcaatactaggaagtattattgtgatagcacgagatagacagaaccgaagcagtgagaactatgttcgattaacagatctcatgccacttctctgcccttgtaaaaacttttcttgtagagggcgagcattggtattcgttgaacagggaacgttcaagggagtattgagtcgagcgatacgtgcatacgtcacacaaacgcttcataaagacggaaaaatgctagaatatgaaattcctttaaacgcatcacctgaaagggaaagggaattctccccacaacctttggcagcaagatgtatttcagacgaagaatcgaatgtgaatccttcgattttgtcatcgagaccatcgaatcctacagcctattcccagcaacctatgacaactaactctacatcctgtggatgttcttcctgtatgtctgaaaaatcaaatagcaatctatatataaatcagtaaaaggaggcggtaaatatgaaaaagtattgtaatcccaataaagtaaatcctaatgaagtgaatccaacagaatttattttattcgacttggactattatttagatcataatatggcgaatgtggaaagttatcctatagagttgtactacatgctcgatgattataagccatcagggggttggcattttgatagaccataccttcctaccccaacttcttatcaagtacctaacgcttgcgtatcagtaaacggtctaaactattgtacctttaaaccatatcaagagaatgcttggtatgtagatacagccaatttgatcgcagaagggacagatacgtatgaagacatcgaatcaatggctctagaaacccctattattgcggatagacatgaatatcataataactcatctttacaacaatcctatgtgtccccagcctattcggaaacagtgactacaaccacgacaaatacaacaacacacggatgtaaagtaaatccaaaaatctcttattcgcgtaaatcgaaatataaagtcggcattaaggatatagaaaatggatttaacctggaattaggggccgaatataacttcagtaatacaaacacaaatacggctacgacaactcgaactgtgacatttccatcatttacgacacaagttccaccctataccactgcgattgtgacgattctattaaacaaaggaacgtatgccaattataatgttccagttcaaacgaatttatttggaagatttgatcgagtcgacatcagagacacccctcctagcgtgggcgcgacgtttgatctataccctttcgtagaattagttcaaacatgttgtgatgcaacttgtagtgattgtgtaacagacatggtgcaagctcttcctgacaatctcacggttcgttttaatggaacagggtcatttatagcggatgttgcatcaaataactttgtcgtaaatactgaatttgttgacaatgcaacaggagcaaccgtttcgaaaagaacagaatacgtacccgctatttacggacccgctaccacgtcggtaagcacatcttaatagaagactagaaaaggggagttacgcttagacgtcaactccccttttttctatatatgggggctctatcgggtgatttctgtttctcatttacgtcataagtatagagaagagaaattcccgtgtatatgggatctgtttgtttagaaaatcaatcat

SEQ ID NO: 50 - protein, 1212 aa, Bacillus thuringiensis
MKNVWKVILCNKCIGGKRMSPNNQNEFDIIDVPSNISVSNSFVRYPFANDPNRTLQNTNYKDFLTMSEKSNSGYLTDPEAFDDVGSAIFAGLSITAKIMDAFDVPGGDIFNGLLEIIGILWDLQDDTWEAFMEQVEVLIDQKIAEYARNLALTHLKGLENSYKLYLEALADWKQNPTSPSSQERVRTRFRDTDDSLTVFMPSFAVKGYEVPLLAVYAQAANLHLLLLRDSVAYGLGWGLSQLNVNDNYNRHVRLTGEYTNHCVSWYTTGLEKLRGSNAQSWIKFNRYRREMTVMVLDIVALFPNYDARRYPQATTTELTRLIYTDPHGYTIYSPTSQTTIPWYEYGQSFSEIENVAIQAPRLFRWAQEMQIYTKFVRHAPQESHYWAAHTFSFHHTRDNTKTTLTYGDTSNPISVGTADLSDLDIYKVSSLVASSWGSGVRLLVTKAKFEVIYTFNQLWEFNYEPPGISNFFNQWKNTDTELPIQIVDPPTFGDPNQYSHRVAYISHAPIQPYSGAFRNYGLVPVFGWSHVSVDRNNTLYADRITQIPAVKAVQLSGEPYPVVRGPGFTGGDIARLPNNPNVGLLFNSKVESPSENKRYRVRIRYACASGARAIFGGLYLPITVQFNQTMSTTTPTRYEDFQYVDVSGTFILGNTNVSFSLVPQSANQTNNLFIDKIEFIPENPALEAESDLEAAKKAVNALFTNSKDTLQIGVTDYQINQAANLIECVSDEVYPNEKRLLFDAVKEAKRLSTARNLLEDTDFHTINGGNGWTGSTGIEIVEGDILFKDRSLRLPSAREIERETYPTYIYQKIEESRLKPNTRYSLRGFIGSSQDLEIYVLRHQAYRVIKNVSDNLLPNMRPINACGGVDRCSQQKYVNNSLEVNSGLSNGIGAADSHEFSIHVDTGELNYNEDMGIWVVFKITTTDGYATVGNIELVEVETLSGEALERVQRQEKQWQGQLATRRKETETRYGPAKQAIDRLFVDFQDQQLSRSTEISDLTEAQNLVQSIPYVYNDMLPEIPGMNYTSVTELTNRLQQAWNLYDQRNSIQNGDFRNDVSNWNVTTEVNIQQMNDTSVLVIPNWDSQVSQQITVQPNRRYVLRVTARKEGNGDGYVTIRDGANHTETLTFNTCDYDGNSVYNNQPLNANNNVYTTKSSNTNSYHTNGVYHDQTSYVTKTMEFTPYTEQVWVEMSETEGVFYIDSVELIVEEM

SEQ ID NO: 51 - protein, 1226 aa, Bacillus thuringiensis
MKNVWKVILCSKCIGGKKMSPNNQNEFDIIDVPSNTSISTNFVRYPFVNDPNSNTLQNKNYKDFLTMSEKSNSGYLTDPEAFDDVGSAIFAGLSITAKIMDAFDVPGGDIFNGLLEIIGILWDLQDDTWEAFMEQVEVLIDQKIAEYARNLALTNLKGLENSYKLYLEALADWKQNPTSPSSQERVRTRFRDTDDSLTVFMPSFAVKGYEIPLLAVYAQAANLHLLLLRDSAAYGLGWGLSQLNVNDNYNRQVRLTGEYTNHCVSWYTTGLEKLRGSNAQSWIKFNRYRREMTVMVLDIVALFPNYDARRYPQATTTELTRLIYTDPHGYTIYSPTSQTTIPWYEYGQSFSEIENVAIQAPRLFRWAQKLQIYSKFVRHAPQESHYWSGHTFTFHHTRDDTKTSLTYGDIIDYKYLSEADLSNTDIYKVSSLVASSWGSGVRLLVTKAIFETINTSNKLIDYEYDLQLLSNFFNEWKNTEAELPIQIVNPPIFGDFNQYSHRVAYISHAPIQPYSGAFRNYGLVPVYGWSHVSVDRNNTIYADRISQIPAVKAVQGSGEPYPVVRGPGFTGGDIARLPNNPNVGLWFNSKVESTALNKRFRVRIRYACATGARADFGGLTLPITVQFNQTMSTTTPTRYEDFQYVDISGSFLLTNTNSGFSLVAQSANQTNNLFIDKIEFIPENPALEAESDLEAAKKAVNALFTNRKNVLQTGVTDYQINQAANLIECVSDEVYPNEKRLLFDAVKEAKRLSATRNLLEDTDFHAINGGNGWTGSTGIEIVEGDILFKDRSLRLPSARETDREIYPTYIYQKIDESRLKQNTRYSLRGFIGSSQDLEIYVLRHQAYRVIKNVSDNLLPNIRPINACGGVDRCSQQKYVNNSLEVNSGLSNGIGASDSHEFSIHVDTGELNYNENTGIWVVFKIATTNGYATLGNLELVEEGPLSGDALERVKNQEKQWQDQMTRRRAETENRYGLAKQAVDRLFVDYQDQQVSPIIEISDLTAAQNVVQSIPYVYNDMLPEIPGMNYTSVTELTNRLQQAWDLYDQRNSIQNGDFRNDVSNWNVTPEVNIQQMNDTSVLVIPNWDSQASQQITVQPNRRYVLRVTARKEGSGDGYVTIRDGAKYTETLTFNTCDYNGSSVYQEQALYTNDVYNTQSANIHGSNSAYHTQASNTDRYNMNGMYNDQTSYVTKTVEFIPNTEQVWIEMSETEGVFYIESVELIVEEN

SEQ ID NO: 52 - protein, 1196 aa, Bacillus thuringiensis
MSPNNQNEYEIIDTPSSNSLDNQFVRYPLAKEPTQVRQNLNYKDWLNSLDENNNQSFGVTPRRASVVGAVGSILGATLGTIPYVGDILALIVGIFWPEGSDPEDYSELINAIMEQVELLIDQKISEQVRNDALATLESSGIALQAYLNALEDWKINPNNARSTQLVRERFTFAEAQVRTNIAYVSRKDYEILLLPIYAQVANIHLLLLKQVQLYGTKLGYTQNDIDLIYEEQKKFTAQYTNHCTNWYNIGLNNIWESIAGTSYSGSRWDEFNDFRRDLTLTVLDIVSTFPIHDTRLYPEKVNGQLTREIYTRSINVNYFNQVSARTIEDAERLLTNPPRLLPWIEQLEFNTNVNFSVNWKFLTSTRRRFIYTNSSDLNYDGYAGYHLDGTSNSFLYPSNNERIYTITAQRFGEQRNIPQAITGLTFSMNTGRTYRYSSNTPAGPSIITEDYHLPGLNGEEVPNSNNFSHFLRSINGYSNGNQRIFHSFGWTHASVDFENKIYPTIITQIPAVKAIQGTMPYPVVKGPGFTGGDIARLPNNPTLGLWFNGTMESLGSGHDPAPRYRVRIRYASQSGGSANFRFMSSNGQNSSQQNFSFTSTMTTGEPSKYEDFRFSVLPNIVTPLSFNVSWHLVASNANPNNNVYIDRIEFIPEFLMARSDLETAKKAVNELFTNTKNSLRREVTDYQVSQAVSLVECLSDELYPNEKRMLIDAVKEAKRLSEARNLLEDIDLKVISEYGEDGWIGSKGIEVAKSNPLYKNDLLRLPKVREIEGEIYPTYLYYKVDESLLKPYTRYKFRGFIESSRDLEIFVIRHQAYRVVKNVPSNLLSDIGPVNACGGFDRCSEQKYVNSMLELDNDLSNENRSSEAHEFSIHVDTGELNYSENPGIWVAFKITKMDGYATVGNLELVEVETLSGEALERVQRQEKQWQGQLATRRKETETRYGPAKQAIDRLFVDYQDRQLYSGTKISDLIAAQNLVQSIPYVYNDMLPEIPGMNYTSVTELTNRLQQAWNLYDQRNSIQNGDFRKDINNWNVTNGVNIQQMNDTSVLVIPNWDSQVSQQITVQPNRRYVLRVTARKEGSGDGYVTIRDGAKYTETLTFNTCDYNGSNVYQEQALYTNDVYNTQSANIHGSNSAYHTQASNTDRYNMNGMYNDQTSYVTKTVEFIPNTEQVWIEMSETEGVFYIESVELIVEEN

SEQ ID NO: 53 - protein, 1134 aa, Bacillus thuringiensis
MMDVNKFYGSRNVNRMLNNPFNNSTQKELLPVVTQNPCVDNPFVNKINQTEMLTNTSIALNTVAGVTGAVLGSLGVPGASLITSFYQKVLGLLWPTNSRAEIWDSFISVVEDLIKKEVENYAREKAITELEGLGDNMKDYKSKLQQWLDTPNDDTKRSLKHYMESLDMDFKEHMPQFRIKGYEVQLLPVFAHAANLHLSLFRDMVLYGPDLGFTPEDLSEDYQQLQQRIIDYTNHCNLYFEQGLSSLKKSSYEEWVIYNRFRREMTLMVLDIIAQFPYYDVKKYPKPVSTQLTREVYTDPLITSFFQPGQGPNFSFMESNAIRNPHLVTYLDSLYIYTAKFRAYSQEIQPDLYFWTAHKGKYKLSASTDVHDTALYGSTSGSISEKNYSFNGNNIYQTLAAPSAVFTTSKQYYGIEQVEFYGDKGKIHYYGDRKYPLSVDSANQLPPDEEPISENYDHILTHASAVNVLDGGTVPIFAWTHRSADYYNTIYSDKITQIPAVKINKLENPSTVVKGPGFTGGDLVKRGSTGILGYLNVTVNSPLSQRYAVKIRYASTISGDFHVQIDGVATLEGHCESTINSGDELSFESFSYKEFSTTVQFTGNKPRLRLSLDKVAGTGVFYFDKIEFIPVDVNYDERVQLEKAQKSVNALFTAGRHALQTDVTDFKVDQVSILVDCVSGELYPNEKRELLSLVKYAKRLSYSRNLLLDPTFDSINSSEENGWHGSNGIVIGNGNFVFKGNYLIFSGTNDTQYPTYLYQKIDESKLKEYTRYKLRGFIENSQDLEAYVVRYDAKHETLDVSDNLYPDISPVNACGEPNRCAALPYLDENPRLECSSIQDGILSDSHSFSLNIDTGSIDSNENVGIWVLFKISTPEGYAKFGNLEVIEDGPVIGEALARVKRQETKWRNKLAQLRTETQAIYTRAKQAIDNLFTNAQDSHLKIGATFASIVAARKIVQSIREAYMSWLSIVPGVNYPIFTELNERVQQAFQLYDVRNVVRNGRFLNGVSDWIVTSDVKVQEENGNNVLVLSNWDAQVLQCLKLYQDRGYILRVTARKEGLGEGYITITDEAGHTDQLTFGTCEEIDASNTFVSTGYMTKELEFFPDTEKVRIEIGETEGIFQVESVELFLMEDLC

SEQ ID NO: 54 - protein, 748 aa, Bacillus thuringiensis
MTPQHLINLFERNFIWENNKIISEGINMKSKNQDMNQRLSYNTTVDKNSTDSLRNETDIELKNINHEDFLRMSEHESIDPFVSVSTIQTGIGIAGKILGTLGVPFAGQIASLYSFILGELWPKGKSQWEIFMEHVEELIDQKISTYARNIALADLKGLGDALAVYHESLESWIKNRNNARATSVVKSQYIALELLFVQKLPSFAVSGEEVPLLPIYAQAANLHLLLLRDASVFGKEWGLSNSQISTFYNRQVERTSDYSDHCVKWYSTGLNNLRGTNAESWVRYNQFRKDMTLMVLDLVALFPSYDTLVYPIKTTSQLTREVYTDAIGTVHPNASFASTTWYNNNNNVPSFSVIEAAVVRNPHLLDFLEQVTIYSLLSRWSNTQYMNMWGGHRLEFRTIGGAINTSTQGSTNTSINPVILPFTSRDVYRTESLAGLNLFLTQPVNGVPRVDFHWKFATLPIASDNFYYPGYAGIGTQLQDSENELPPETKGQPNYESYSHRLSHIGLISASHVKALVYSWTHRSAERTNTIEPNSITQIPLVKAFNLSSGAAVVKGPRFTGGDILRRTNTGTFGDIRVNINPPFAQRYRVRIRYASTTDLQFHTSINGRAINQGNFPATMNRGEDLEYRTFRTVGFTTPFSFSDIQSTFTIGAWNFSSGNDVYIDRIEFVPVEVTYEAEYDFEKAQEEVTALFTSTNPKGLKTDVTDYHIDQVSNLVESLSDEFYLDEKRELFEIVKYARQLNIERNM

SEQ ID NO: 55 - protein, 1168 aa, Bacillus thuringiensis
MNRNNQNEYEIIDAPHCGCPSDDVVKYPLTDDPNAGLQNMNYKEYLQMYGGDYTDPLINPNLSVSGKDVIQVGINIVGRLLSFFGFPFSSQWVTVYTYLLNSLWPDDENSVWDAFMKRVEELIDQKISEAVKGRALDDLTGLQENYNLYVAALDEWLNRPNGARASLVSQRFNILDSLFTQFMPSFGSGPGSQNYATILLPVYAQAANLHLLLLKDADIYGARWGLNQTQIDQFHSRQQSLTLTYTNHCVTAYNDGLAELRGTSVESWLKYHQYRREMTVTAMDLVALFPYYNVRQYPNGANPQLTREVYTDPIVFNPPEHPSGFFCESFYTIRAARERLTFSQLENAIIRPPRLFERFQALGIYTGELQLGQGSTPMNHWIGHFIRNTRLGDSTTITTNYGTTNNRLTNFIPPTTSDVYQINSISSNAASFLNTFFGVTRAQFHYGSGIIWSYVGQNNVLPPCLQNYNSIEELPNQSEEPTVRSYSHRLSHITSFNFNVQLNSPLRSSGNMPVYVWTHRSVDLNNTITSDRITQLPAVKASTLGAGAIVVKGPGFTGGDVIRRTSVGNFGRIRVTVNSPLTQRYRIRFRYASTTDLQIGINVGNRTVNLFDFPSTMNSGQESKYESFVTREFTTAFSFTQTQETISAFAQSFSSGQVYLDRIEIIPVNPAREAEEDLEAAKKAAASLFTRTRDGLQVNVTDYQVDQAANLVSCLSDEQYGHDKKMLLEAVRAAKRLSRERNLLQDPDFNEINSTKENGWKASNGVTISEGGPFFKGLALQLASARENYPTYIYQKVDASVLKPYTRYRLDGFVKSSQDLEIDLIHHHKVHLVKNVPDNLVSDTYSDGSCSGINRCDEQHQVDMQLDAEHHPMDCCEAAQTHEFSSYIHTGDLNSSVDQGIWVVLKVRTTDGYATLGDLELVEVGPLSGESLEREQKDNAKWNAELGRKRAETDRVYLAAKQAINHLFVDYQDQQLNPEIGLAEINEASNLVKSISGVYSDTLLQIPGINYEIYTELSDRLQQALYLYTSRNAVQNGDFNSGLDSWNATTDASVQQDGNMHFLVLSHWDAQVSQQLRVNPNCKYVLRVTARKVGGGDGYVTIRDGAHHQETLTFNACDYDVNGTYVDDNTYITKDVVFYPETKHMWVEVSESEGSFYIDSIEFIEAQE

SEQ ID NO: 56 - protein, 695 aa, Bacillus thuringiensis
MRSMNSYENKYELLDASQNNYNISNRYLRYPLTNNPQDSMKHTNYKDWLAMCENSPQYDVNPAEINSSSVSTALKILGTLVKFIEKIEGIGPVFTALSAILPVLWPPNTPTPERVWNDFMTNTGSLIDQTVTTEVRNQANAMMADVKENLYRYTSSFNAWKGTPTNNPNYPNYLAAVIREFGLVEAKLRSAAAYFSNRVGYELLLLPIYTQVANSHLLLIRDGLIFANEWSLARSGDELYKEFYRYTSIYISHGIKYYNEGLNTLKNRNVPWGTFNDYRREMTIQILDIMSLFSSYDARKYPADRTDTTILPKTELTREIYSALLDSPPNKPIAQLEESLTRDVHLFTWLKNVEFWTFNYNMYPDTRYLSANRIGFSYTNSSAIQPSGIYGSTAFGTALTHSFPLNSNVYRISTKDTTAVPNQVTNIDLNLINGTSALYNSGIIPVPNNLRTTLFGFSSNESRPNQPTIQDYTHILSYIKTDIIGGHRSRVSFAWTHRTVDPNNQILTNNITQIPAVKSSLLNTQARVIKGPGHTGGDLVAITSNGTQSGRMEIQCRASNFIEPDRRYRLRIRFAANSNLLVNVTYTSNGIPRQTPFTTNLIPANNEMFFPGNTIPADLKYEYFYYRESFDTILPMRVTSGELITVAIQPTNMLSNQILIIDRVEFIPITQSVLDYTEEQNLETAQAVVDNLFTN

SEQ ID NO: 57 - protein, 606 aa, Bacillus thuringiensis
MNENVIRAKESVQSLFSSPTTLQINATDYHVDQAAKLVACISDPIYTKEKLCLLEQVKLAKRLSRARNLLNYGDFESPEWSEENGWKATTRVFVQADYPILTGHYLHLPSAYQTQLSDTVFPTYAYQKIEESKLKPYTRYSVRAFIGSSKDLEVFATRYDKEVHKTLHVPEDRMPTNLRTGEDLVEPGSHPMMTNPINPQNLPYDSCGDGSYGMIQQTSVVCADPHEWQCHIDTGELDMIRNLGIWVGFKIGTTDGMATIDHVEVVEVGQLTGEALTRMKKREQRWQKKWAEKQIRIERAVQAAKEALQALFTDSNQNRLQSAITLKQILEAEIWVGQIPYVYNPFLVGTVPVVPGETYDIFQELSSTVAIARALYTRRNLLRNGDFTAGLANWNTTEGAQVQQIGNISVLKLSDWSATLSQHVCWDPEHSYLLRVTARKEDVGEGYVTIGDGTGDNTETLQFTVGEELTSVAIVTNRLNLLQLYNESYGTNSSIGTTGISRYANDQAESFRFTPYGDENSRRDYTSSPYEMNVYPGITNRPMKQGMGCGYYDSYPIINQNMPDFSSYITKTVEIFSETNHVYIEIGETEGIFQVASIELIRMDCE

SEQ ID NO: 58 - protein, 645 aa, Bacillus thuringiensis
MKKMNSYQNKNEYEYEILDTSPNNSTMSTLHPRYPLAKDPYKPMRNTNYKEWLAMCANNNQVPIDPLDNTWAGVMAALFASAAAIAGLMSAVPVFSVVATGTALAAALTPILFPSNGPDVSTQLMSNTEALLKRELDTYVRARADSEFQALEAQREFFKSAFDYWRLNPTNSNAIATVAARFHTVNGAFVTAMRLFRTAGYEALLLPVYAQAARLHLLHLRDGVLFANEWGLAKDPGDLHDQEFNKYAAEYADYCESTYNTELNRIKTAPGKTWLDYNQYRRIMTIAVLDIAAKFSILNPRLYRLPLQEEILTRKIYTDPVNFSPGPSIADDENRYTVPPSIVRQLVGSTLYTNVASAQNAGFIGNRNRYLNIGFGETVDGPLIGNSVYESRVAGIPTNEWVYEVGVNGIQNDYPRNIGLRRGSSTDFINNYAGSQYNLGPLTRVSIPTKNNDPINNINFTHRLSDIILPGNRGSSFAWTHVDVNPTGNYLSTNQINLIPCTKISKLPNSYQIIKGPGFIGGDLIRFTSGSGYLYKFKFTSSGSSANFKIRIRYAGAGTGPGLYGRVFFRLGNYQSPDTPWGQTGFTSSNAKYNQFKVLELYGTAENITDNDLEIIVWTANSGAQDFLSRQIGINPNAGDINRIQ

SEQ ID NO: 59 - protein, 567 aa, Bacillus thuringiensis
MSPMYINTMKNTLKLETTDYEIDQAAISIECMSNEQNPQEKMILWDEVKQAKQLSWSRNLLYNGDFEEASNGWKTSYTIEIGKNSSIFKGQYLHMFGARDVLGEVFPTYVYQKIDESKLKPYTRYRVRGFVGSSKDLKLVVTRYGKEIDAIMDVPDDLAYMQPNPSCGDYRCESAAPQYVSQGYPTPYADGYASEMYACPSDRVKKHVKCHDRHPFDFHIDTGELDINTNVGIWVLFKISNPDGYATLGNLEVIEEGPLTGEALTHAKQKEKKWNQHMEKKRWETQQAYDPAKQAVDALFTNVQDEALHYYTTLDHIKNADQLVQSIPYVHHDWLPDAPGMNYDVYQGLNARIMQAYNLYDARNFITNGDFTQGLQGWHATGKVDVQQMDGSSVLVLSNWSAGVSQNLHAQDHHGYMLRVIAKKEGPGKGYVTMMDCNGNQETLKFTSCEEGYMTKTVEVFPESNRVRIEIGETEGTFYIDSIELLCMQGYASNNNPQTGNMYEQSYNGNYNQNTSDVYHQGYTNNYTQDSSSMYNQNYTNNDDQHSGCTCNQGHNSGCTCSQGYNR

SEQ ID NO: 60 - protein, 1237 aa, Bacillus thuringiensis
MKKMNSYENKNEYEILDASQNNSNMSNRYQRYPLAHNPQTSIQTTNYKDWLKMCQNPHQNPLDMEGYDSNSVVVVSTGLIVVGTLISILSAGLGSIPIIYGTLLPVLWNDPNNPQKTWHEFMSHGETLLNQTISTVERNRAAAYLEGYTTAVKKCEEALNVWLTAPNQANARTVADLYKDTDFLFFTTLPHLKLRDFETLLLSSYTQAANMHLILLKQASKYADQWNAQLPVSVRKTANDYYTDLVKLIGEYTDYCIATYRSGLNTIKSRATSWNIYNMYRREMTILVLDLVALFPAYDIKKYPSGTKVELTREIYTDALGAVAIPQNIDATEQLATRAPNLFSWLKGFKFITTQSTNRYYLSGIANRYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCTQNCNPTFNNYSHILSYAKTFTSNLTIGTTSNITSFGWTHNSVDRENTIDLNNITQIPAVKASQVYPENSVIKGPGHTGGNLVRIDSSGYMSIVCKFPLQVKGYRVRIRYAANNRAELYISSAGNSPSKNVDLDPTFSGTNYESLNYTNFKDKETEFIITEGQLVKQSIIFSTNGNVLLDKIEFIPLGTTTYEYEEKQNLEKAQKALKALFTDGTNGYLQMDATDYDINQTANLIECVSDELYAKEKIVLLDEVKYAKRLSISRNLLLNDDLEFSDGFGENGWTTSDNISIQADNPLFKGNYLKMFGARDIDGTLFPTYLYQKIDESRLKPYTRYRVRGFVGSSKNLKLVVTRYEKEIDAIMNVPNDLAHMQLNPSCGDYRCESSSQFLVNQVHPTPTAGYALDMYACPSSSDKKHIMCHDRHPFDFHIDTGELNPNTNLGIDVLFKISNPNGYATLGNLEVIEEGPLTDEALVHVKQKEKKWRQHMEKKRMETQQAYDPAKQAVDALFTNEQELDYHTTLDHIQNADQLVQAIPYVHHAWLPDAPGMNYDVYQGLNARIMQAYNLYDARNVIINGDFTQGLQGWHATGKAAVQQIDGASVLVLSNWSAEVSQNLHAQDHHGYMLRVIAKKEGPGKGYVMMMDCNGKQETLTFTSCEEGYITKTIEVFPESDRIRIEMGETEGTFYVDSIELLCMQGYASDNNPHTGNMYEQSYNGNYNQNTSDVYHQGYINNYNQNSSSMYNQNYINNDDLHSGCTCNQGHNSGCTCNQGYNR

SEQ ID NO: 61 - protein, 1433 aa, Bacillus thuringiensis
MSMNQTDVMNVIQAAEIEGIKRSQEKYPNRELSVFQHNVLSGNLYANLKQPTLVTSTDIQETNTVNCKCSLKKAPHVVGRNMSLSSCLEQCGDLDLQIQAIDLQTGIGTALSITSILVNPGVGSAFALIRTILPLLWPSQSQDPNKVWQSMMATAEELVDAKIDTVMRNLAISKLNGIKSLIDYFNDLISILAQDPNNTNKREAVLDAYRDVDRAFIESMPQFAVPGWETQLLPVYAEAGNLHLLFLRDAVKFGSEWNMNQWEIDLNYKYLKDNIKSYTNHCVNWFHTGLKRLNPETNPSHKPANMRDCTKYPWIAYDQYWEVNPTRDCSPTLLTSICEEKTNESPPQVASIYGYRGYRESSGEYQGLENWNLYNNFRRDMTIMVLDILPAWPTYDPQLYPDIGIKTELTREVYTQIRGTTYRSSASQNTISAIESRMIRPPSLFTWLTKLDFQQIHVTSPTPGQDPGYPYTAGNLLVGGSQSLMYTLGDSFEENFGKIGTLPVKTVNLTPDNSITQFQTKQWFEPREIALYKRDAHLFTLGTIEEKTPHFSRTPGCFYTKECIYDPTLRVNQMPKAIDPNNPNAPSSDWKDSHSLSYFKYEPVRSDSPYGNPNDGQIGAVLFGWTHILVDPKNKLESDKITQIPAVKASEGTNYQVIKGPGFTGGDLVNLKTYGSLNISLTVPMPSLNYRLRIRYASKEQKRIRLRILRNNVWSEYGDFDIPTTYSGNQLTFDSFKIFTVSTVLFSSTSILYIERIDPFSELLTIDKIELIPITGSVEEYEANQKVEKARKVVNALFSNTVKQRLRDNLMGIDLDIAMGLVEEIPDDRFPKEKMILRDQIKQAKRMSQSRNLLQSGDFASPDWSGENGWTVSNSVSVEATNPILHGKYLNLPSARDPLSDGTLYPSYVYQKVDESKLKPYTRYWIRGLIGNSKDLELIVSRYRKEVHKTLHVPDNLNLMSLRSHLESLSGPEILEQVQQKLQDPSCGTYSPLIQINNEGEDPHIFSCHIDVGELDLACNLGIEVALKVHTVDGRAQVRYLEIIEGAPLTSEEVARVKRQEKKWKQKRKQTFTQNQETIQAAQEAINRLFVSPTCGRLKLTTTLQDIEYAQTLVDAIPDRYNQILPALPGLNMDIFGRMQNQLELAYGLYNNRNVVVDGDFMSGLVNWNATEGAEMQQIDGTSVVVISDWGANVSQEVCVNPEHGYLLRVTARKEGLGKGYVTISDCTENNTETVTFVSDEERMASTESLRDTSIATARETPYMSNNQTIHVPSDSYGKNTSYAGNPNRNYSSESFGFTPYGNQNQMMNYSPIHDEMNVYANNPNMTSGHESGCGCGCRTNAYAPEYKRMNRPSNQDEMNAYPMNESTLTNDEANAYKTASYASPTPVQNSTFLSGYVTKTVEIFPETNRVRIEMGETEGTFMIESVELIRME

SEQ ID NO: 62 - protein, 329 aa, Bacillus thuringiensis
MVRDYPDFDGMLRKAARKWAEANRLTFQDISYADPLTNSDTISLNVKFKDIGCPEECVELERISVSQAFTNNTGQQQKETFKTTTYVEDEYTWENDYHFVLPGQNFLIMPRLPRSAHRDINPGFLVNFFGENQQFHTKMRELRPIEGEVFLEPSSSATIQLQVEKQYISQPYEIELSILGSIIVIARDRQNRSSENYVRLTDLMPLLCPCKNFSCRGRALVFVEQGTFKGVLSRAIRAYVTQTLHKDGKMLEYEIPLNASPEREREFSPQPLAARCISDEESNVNPSILSSRPSNPTAYSQQPMTTNSTSCGCSSCMSEKSNSNLYINQ

SEQ ID NO: 63 - protein, 352 aa, Bacillus thuringiensis
MKKYCNPNKVNPNEVNPTEFILFDLDYYLDHNMANVESYPIELYYMLDDYKPSGGWHFDRPYLPTPTSYQVPNACVSVNGLNYCTFKPYQENAWYVDTANLIAEGTDTYEDIESMALETPIIADRHEYHNNSSLQQSYVSPAYSETVTTTTTNTTTHGCKVNPKISYSRKSKYKVGIKDIENGFNLELGAEYNFSNTNTNTATTTRTVTFPSFTTQVPPYTTAIVTILLNKGTYANYNVPVQTNLFGRFDRVDIRDTPPSVGATFDLYPFVELVQTCCDATCSDCVTDMVQALPDNLTVRFNGTGSFIADVASNNFVVNTEFVDNATGATVSKRTEYVPAIYGPATTSVSTS

SEQ ID NO: 64 - protein, 320 aa, Bacillus thuringiensis
MVRIYPRLNELIREAARKWAENNQFRFLRSTLLDPDTNDETVVMNTTFTEIGSPEECMDLEPLQIKQSFTNNTDQQTTEIFRDVVYVEDDFTWENEYEFNISELKLLTIPRVPKLAYKDINPGFQVDLFGPNRVFSTKMREMRPLRAEVFLEPHSSVNLKAKVERQQFSQEYQLELSIQGDVVVTTERTTGESEEYYVSLRDLIPFFVLPNNFTLEGQALVFREKGKFTGILYRAIHLYVTQTLYNERKILEYEIPLLPPLDDLRSRLVEAIGARRLSPQEDEFTVVSSTSQTVPPKEQDQCGCSSCLSSQSNTNLYTDQ

SEQ ID NO: 65 - protein, 332 aa, Bacillus thuringiensis
MKTCTNNSNPRNTVLLELDDYITHVVKENVVLGPPDLVGRKMGYPPGLGSWRMDSSYFPTPTSSQVPGPPCNTTFTCRYYPSPAWGYNTNSMIAEGINKVIEAETVALAQPIIMDIHNFSNNTNVQQTYYTPEYSEVTTTTVTNSTTSGIKSGTKISASVKFKILKAEFGVNTEVSSEYNFSTTQTITTTTSRTVTFKAQPVVVAPHTTVQVTVLLNRVVYQNEAVPIEADLSGRIYSDDGSVGLDFYPTFEFFNRCCGTAECCKLPDSLKIGSNNKVRFTGIGYFQSDVPSNNFQITTDIIDDATGATISRDVQFVPATFGPILGTTTSTS

SEQ ID NO: 66 - protein, 1316 aa, Bacillus thuringiensis
MANLNEIYPSFYNVLAYPPANFDNDPSSWEVYKKNQKELNDKWNDYDSNFLPDPVMDTINSLVNIYKDTPGSYVQFAQMAIRDAFLVLPGGQTAAWAINKVLGLIFPSHEKSLFDQIMEAVKEMVEADFKNLALNQIQAVIEGFRSPLGHFSDSIQLALGKPTFPTSFPPSGVSIIMPSNSTDCSKDSDCNCSNSAPNSDSNAAPCTPCSCRISNVYQEFTNTRDIIEAALPGLLNPLNNILNGTSMADYMKMGLPLYVIAASLNLALHKNYIAFAQKWDYDPAGTNVIVRNLRDRIIEYSNNVYTIFTKYLPPLTDNSKSGLNAYIRYTRNITLNALDTVAGWPMMNTNDYPIGTNVKFTRILFNDIVGPVEYYKGSPTRDDSSLHFNLYDLNKKQLPNNSISDYFYNGMQLSSLKFQTFYHSYKECYPLGLDASYDANNGVPIRQLQSNSRGTSWSNNLFEDWPLLSSLNMASTQGGYDVANIIAEGDTISSGCDGDPRTISHNPAYVNQRIQAIYPVQPTNPSSYPGYGSTDKIGLITTLIPNDTTYLIDLNPEEISTFPAELSYDTNGTTLIEYMNGAAALQLMPNQYAKYIISNYDMDTSSSQGVQVRVRAATTQDGGSLSITVNQQTQTLKLSNTTNTDYTQIVIKGKQGYYGLFPPTDSQNPKQRTSNIFQLPNSYNNTAIIQNNSQVPIILDRIEFVPVSAPAPDPSPDSGKPIHKSVPKTVTQLSTTKEIWSSTSEYATTISFTGNVYNDASITFQLLSSGQVVKEFPFTGNGVASKPGFHGSSPSCYDTPYPFSQPDLSVPKYNKLQVVMKSDGYSKPCDLGDSFPNTFDAEIDIKFNLSDTADLAQITAQVQGLFTSSSSTELSPNVSGYQIDQIALKVNALSDEVFCKEKIVLRKLVNKAKQFMKTRNLLIGGDFEILDEWGLGTQATIVDKSAFFKGKHLFLQPTNGIFSSYAYQKIDESKLKPYTRYKISGFISQSKDLEVVVSRYGKEIDKILNVLYEAALPITSGTNPTCCKLSPYPSCDGSQPDSHFFSYIIDVGKLYPDLNPGIEFGLRIVQPNGHAKVGNLEMVEERTLTSTEIQKIQRKEGKWKKAWDTERAEISATLHPVINQINAFYINGDWNGPILPHITYQQLANVILPALPKLKHWFMTNRPGEHYAILQQFKQALERVFNQLEEQNLIHNGSFTNELSNWLVEGDAKITTLEGGNLALQLSDWDASASQSIDISDFDEDKKYKLRVYAKGNGTIQDANCEGGQLSFDTNTFKYLERTLYFDTPSVLLHIQSEGSEFIVGSVELIELPDDE

SEQ ID NO: 67 - protein, 1295 aa, Bacillus thuringiensis
MIFKNSNNNFLFYCSRRYFMVILNDIYKGPYNVLANPPIILDTENPQNPWDSYVNWRQELNDSWAEYDEDFLPTPVMKIIDDIANAYEGKPGSYLSLAQDGIRFAFLFLPGGQSAAFAINKILGLIFPTHQPSLFDQIKDLVEQMIDQKFEQQEINSNINRLNGLITQLGQFSNSIQQALGKPMDFPVTHLSSTTNKLFDDTNIFDTNYDCSTDPNCSCSETPNRSSDASPCTPCPCRIKGVQDEFIATRKVILDILNNMKTSLDGVLTKEHATTYMQIFLPIYTKAATLLFGMYKSYIEFATKYNFEMGDNGNTMKYTNELRQYISTESSYVYNEFNKYLPDSKVLTKGDLNKYIQYSRTITLNALDTVSTWPLYNILEYPISTTLNPTRLVFNDIIGPVECKTNNQNSDSLSFSTLYDYTGNNLLNNDITNYFYKNTQLQSLSFQRYKSPKNNPIAQDIIVGVSANYSDGIQFKKEASWSPYKGYTLEWENDVLKDYPTLSIMNAVSLQDNGGFVAIDESWLLYNNLSSASCASQNNIVFPNQKIQSISTLTPNNTKKYSNYGNTDKLGLITTLIPNDTSPSIILNNPIGINTFSAEQATTTTGTRLVEYVNGAAALQLKQGQSAEYIINTSTILSGKYQVRFRAAMNDADNACHLSFTINNSTETVTLSKDTNPLKIVGKQGTYMISSPTSFQIPSTTKLSMSVLNTGDNDVILDRIEFIPAVINKDQIKIPPQDVYIPFKGHTPLWNSKDERIVTHAIFEQPVQRRYLRLYLKDKYVDLVPDDGIVTTPFDSIILYNSTEPSAVNIHFEGATLTLSPQNQKQFTTLEDLEKITNQVNQLFTSSSQTELAQTVTDYNIDQVALKVDALSDDVFGVEKKALRKLVNQAKQLSKARNVLVGGNFEKGHEWVLGREAKMVANHDLFKGDHLLLPPPTLYPSYAYQKINESKLQPNTRYTVSGFVAQSEQLEVIVSRYGKEVHDMLDVPYEEALPISSDEHPNCCQPAGCQCPSCNGDAPDSHFFNYSIDVGSLQSDVNLGIELGLRIAKFNGVAKISNLEIKEDRPLTDQEIKKVQRKEQKWKKAFDQEQAELAATLQPTLDQINALYQQEDWNGSLHPHVTYQHLSNVVLPTLSKQRHWFMEDRQGEHYNVTQQFQQALDRAFQQIEEQNLIHNGSFANGLTDWTVTGDAHVTIQDDDQVLELSHWDANVSQTIEITDFEDEKEYKLRVRGKGKGTVTVQHGEEELETMTFNTSSFTTQEQTFYFEGNIVDVQVQSENNAFLVDSVELIEVVEE

SEQ ID NO: 68 - protein, 1301 aa, Bacillus thuringiensis
MDNMTNLSDLYSAVPYNIMVTPPLKESSWDDFTEFIKELKGGWEEFEKTGYSKPYLNTLDVAINLYKSGTLDYTALAKSFLSIGSALGEFIPGGAVVVPILSGLVDLIFPHLFGSKSSNSQTEFFDAIIKEVQKMIDKEIQDFTTSLLQANIQGFAEAAKLFQNQIQSAIGAPHAVFGPKLDQGATCNTSPCKTPTKEDLLTVEMQFTASNTTMASQVPLFLLTPTSSDSDTNRETIMLTLPMFVTAATVHLSLYQGYIQFMQKWNSVYPEIDIESRISELGEYIESYSKKALDIYNQYAPTYDINNKDVLNKYIQYNRVMITQVFDMVSMWPSFFPQDYPAKFKTDQTRIAFGNIVGPTEDQPSLHFDLYDVYKNQLPNNDIFNYFYNGMQLDTFDLFSDGDNQKLRNYFTGIKGYYKTYNENVITQDDPGTGRQNIAHSFSSDEVKNLLNINMGSVKTQYLDYNLFYYNCKTSNPGKTPSYTTNDCNQIDIGAIFNSKDLHLSNNTSYSNQKLQAIYPVRNPKQVWGGTNKAGFIYTLVDYDLFPQNIIGSANKDGSLNTNIQGFPAEKGTLNLTAEPLTKVLEPINSAAAVNLKFQQILALPITNVTDQNYEIRVRYASKSDISIFFHIQTPSDDLNRGNQTLKNTENATDIAIQGNNGIYTLQTLAEKVSLPSGNLTVFIQNNSNSDLFLDRIEFIPLSQTPDTFPLTFNPPETTTQPNTTKTIWSGLKPANTFSIQGTVSNDVSITFQLYMNDNLVQEIPVKGPGHGYSSMVGCLDKSSPISQPNIENKEFNKLILKELSDKAPDCFNSTLSNTYKVNITIDNKSQSFTTPEDLEKITNQVNQLFTSSAQTELAQTVTDYGIDQVVLKVNALSDDVFGVEKKALRKLVNQAKQLSKARNVLVGGNFEKGHEWVLGREATTVADHDLFKGDHLLLPPPTMYPSYAYQKIDESKLKSNTRYTVSGFVAQSEHLEVVVSRYGKEVHDMLDVPYEEALPITSDERPNCCKPSGCQCPSCNGDAPDSHFFSYSIDVGSLQSDVNLGIEFGLRIAKSNGFAKISNLEIKEDRPLTEKEIKKIQRKEQKWKKTFDQEQAELAATLQPTLNQINALYQNEDWNSSIHPHVTYQHLSDIVLPTLPKQTHWFMEDREGEHVVLTQQFQQALDRAFQQIEEQNLIHNGNFANGLTDWTVTGDAQITIYDEDPVLELAHWDASVSQTIEIIDFEEEKEYKLRVRGKGKGTVTVQHGEEELETMTFNTSNFTTQEQTFYFEGNTVDIHVQSENNTFLVDSVELIEVVEE

SEQ ID NO: 69 - protein, 789 aa, Bacillus thuringiensis
MLEDAIKNKDTQITPELIKKLQDKGFDYLSIVKGLTGGLLKQIPYAGSILSPLVVGLFPGKGYVTKANVWGEIQDRVSNLIDQKLEESQVNNLIGKLTGIQDNLGIYQTRVGLVNGIKPPIANFIQKDANSDKNKENLRSTIDSLDKDLGRVIPEFAVKGYEAASLPYYVQVANVHLFLLKDALTHADEWGLTDDEKRGYLSRLQQKIQEYSSVVYDSFNKGVEAAKSKGGSTADSWNRTNAYVRTMTLYGLDFVALWPAFDTKHYNQPVKLQQTRELYSNMIGRPINWQDYDTTLQQIHNSGYAGYPGELKQVGVSQWDRIDGIREIFDWTGDGSRDYTLQWGHANKNGYSDRSQTVNNPAIGISAYESNNANFYNMSTITYKQNNEVSWFYGPFTTQSDSKDGSRIDSKAPAGHKLSRVKVQEKRSDLNTISSFVAAYVPEEVHPQNILEAKAITGVPAEKYLAHAGFEDKIEYMNGSNAMVSSKNGDTIDYNVQSPGKQKYKIRLRVATNSDTSVGISINGDSQQVNIKNTEAATKLEDGITVKGVNGKYMLIDGPTVELSEGVNTIQLKNSGGAKIALDRIEFEPIGGELRKWKQEGDKWYFYDENDKKLTGWQKINERKYYLGHSGDGSGMTTEGEMATGWKTIDGVQYYFGHSGDGSGMVTEGEMATGWKTINGVKYYFGQTGDGSGMQHEGEKATGWKTIDGVKYYFNKTGDGSGMQHEGEKAIGWKTIDGVKYYFNKTGDGSGMQHEGEMALGDMTIDGVKHHFNKTGDGTGRDHEGELVW

SEQ ID NO: 70 - protein, 874 aa, Bacillus thuringiensis
MKKQIVSVVACTVLAPMFLHGNGNTVYADNKTKQISPTLEDQQKEMDRKGLLGYYYKEKDFNNLILFAPTRENTLRYDQQTANALLDKKQQNYQSIRWVGQLQSKETGDFTFHLSEDEYAMIELNGKVISNKGKEKQVVHLEKGQLVPIKIEYQADKPIDMDSETFKNLKLFKVDAQQKSHQIQLDELRNPEFNKKETQEFLKKAAASNLFTQKVKSTKDEDDDSDGDSIPDRLEENGYTIQNKVAVPWDDSLASKGYTKFVSNPLDTHTVGDPYTDYEKAARDLDLSNAKETFNPLVAAFPSVNVSMEKVILSPNENLSNSVESHSSTNWSYTNTEGASVEAGIGPKGLSFGVSANYQHSETVGHEWGTSTGNTSQFNTASAGYLNANVRYNNVGTGAIYDVKPTTSFVLNKDTIATITAKSNTTALSISPGDSYPKKGQNGIAITSMDDFNSHPITLNKQQVGQLLNNIPIMLETDQTDGTYRVRDAHGNIVKGGQWNGVTQQIKAKTASIIIDDGTRVAEKRVAAKDYTYPEDKTPELTLKDALKLSYPDQIKETEGLLYYNDKPIYESSVMTYLDENTAKEVKKQINDTTGKFKDVQHLYDVKLTPKMNFTIKMAVLYDGAEGGASSKSIGTWYNANYVNGGNTGKTQFQSKHSSAYVVLSSEAKKKLTQNTNYYLSMYMKADSNIEPTIEVASEKSTITSKKVKLNNQDYQRVDILAKNSESNPIDKIYIKGNGTTNVYWDDVTITEISAMKPKDFSNDDIKVKYNDYSEKLDTWDMRLDNVVFKNITPFQNYVTKYRVKYVGTIPAWSFDKTLNSYELNSDGSLMVNILEYNDGRGIDLNSPSKNVTIYAITDDGREIEVYHKVGSYS

SEQ ID NO: 71 - protein, 489 aa, Bacillus thuringiensis
MYEVIKERSWCRKRYCITGSNKISKCAGRESQYAAFSFRVRRNTLKKKICTCFICVSTLLSIPILGETTHAYNSGNLDHPGYSTKITDNVVDFKEDKEKAKEWGIEREKEWKLTNNEKGKVNDFLNDKNKIRTNYKEITFSMAGSFEEEMKDLKEIDKMFEKANVSSSITTYKNVEPAMIGFNKPLTEGNTINENAMAQFKEQFLNRDIKFDSYLDTHLTAQPVSSKERVILKVTVPSGKGSTTPTKAGVILSENEYKMLIDNGYVLHIEKISRVVKKGYECLQVEGTLKKSLDFKNDINAAAHSWGMKNYEDWATNLTTDQREALDGYARQDYKEINDYLRNQGGSGNEKLDAQIKEISEALGKKPIPENVTVYRWCGMPEFGYQISDPLPSVKDFEEKFLNTIKEDKGYMSTSLSSERLAAFGSRKIILRLQVPKGSTGAYLSAIGGFASEKEILLDKDSKYHIDKLTEVVIKGVKRYVVDATLVTK

SEQ ID NO: 72 - protein, 379 aa, Bacillus thuringiensis
MKFLSKKAMTGLLVGATTLSIWAPASEAAPANNQYYSINLQANQNLVWDVSGSLELPGRPIKNKDIILSNANNNDNQQFAFFPLDDGRYAIVNKNSGKSAIGFDEALLDVSWDGSPAQQWYLRDKGSNNYEIVNQGNGKVASYGKLYTPIPASIQEIVDLDDSNPSDPDRVFYIGNSLSSFELPTLPATGNRPDAPNYTGSVDQQLPQTSNSVVVGASLIPCIMVKDSQASDYTKIHNSPYYTLVKEEYWDKTFSAVIPAGITRTYSFKTGMTSVDQQKMTDTLSMKIGADFGLKYGDSTASLKSEISRTIQTEITSTDTEASEETVNSTVTSEPGKTTGFTEYQLATKYTLKRADGSIVSDPWIVKNNKITVARKNAQ

SEQ ID NO: 73 - protein, 893 aa, Bacillus thuringiensis
MERGKIMNLKSVFKCFTITAILAQLTVYPAISYAESNNEKNMDMKTTIGEKKGVTGLVGYYFKDVQFTNLSLISFGEQSKLANQTKMKKHNQTFESARWMGRIKASQTGEYTFSTASDQNIILQVNGETIINQGKMEKPLKLEKNKAYELKIEYQNIKDTSPDLQLFWSIEGKEKEKIPEENLLSPNLSERDKLSKDNKDTLFLPDFNLFNNSIVKDLPDSDRDGIPDEWEENGYRVQGYDEIVKWDDVDLAKGYKKYVSNPYSPKTANDPYTDFEKVAGFMPAGTKDEARDPLVAAYPAIGVGMEKFIFSKNDNVTDGQSGSVSKTTSSSTSNSHTVGAGTKLELSTNPFALAKWEMALNYSWTGNWTTGFEETNSQSWSREIQMNTAERAYLNANVRYYNTGTAPIYKIAPTTSLVLRDPKDPLNANKTTTIKTVKATNGLVGESLGPEGTYPSQGLAGLALDRLEDGTRISINAEQLDSIQNNSKKLSLETPQVGGQYGLLRDGGLVINDFQTWAPIQSGIDSTSGALVLDTGNINGNLARKVTAKNENDPNDRTPVITIREAVKKAFNAKEKDGRLYYTDPKGKEIDLDESLITFIFDNNTEQEIKRQLENMQDKKVYNARWKRGMNITIRTPIVSYDFENTNNVGWYGATVVNGGYTGNKHAQIAPNGNGYAKTDLELKPHTPYTVRAYVKPSAANHNVVFYTTNDGKGQEYPTTLNGDQWHVIEYTFNTGAHPENFKKLGLKNEGNAILNVDNVFVQEWGAVLGEDATNLINNGDFSEGLNWWEDHKGEIEDGYFKGSYLKSNQFNIKQNKQYQLTFDSKLDIGSNPGKIYVSFLDSGISNIEINLDNSWNHHSYKITFPTDKNVNLAFISLSPKFNLDNIKFEEVK

SEQ ID NO: 74 - protein, 298 aa, Bacillus thuringiensis
MKKAIFSLLATTMSLGMILSPVPQNVKAAEQSKISVYQDLGERVKKMAQSAALSGSAYGHHTIRDAELTGRNIESSMTENSELLTIGENILENNLGHDATLPTSGYEHFFEDKTSTTNTTGWTFGYNFSATLSVLMASATHNFSVDYNMTTARTEEKTQRRTFTLPSQPVPVPAGKTYKVEYKFEKVSISGRNQLNANLYGDVTYYYNNQPLSPQLLYSALGRAADTQGFERIIRDTVSGNDRFGIRATGIGLFKTEFGTRLFASITDITNPRSPVKIETKTIPVEFKTISENTRVVE

SEQ ID NO: 75 - protein, 335 aa, Bacillus thuringiensis
MRNYKKLAVAMPLAGMIMSGVGVLGGPAYSFADTMPQAKVAPMYTNLAAADHYQQFMDMLNSKEMGGEADNFEIVAMPDSGPKNIHITEAKPINAPENTTEVMSYHNVSGIQQSLKTPSKKITHKNTLAIKNGGSIKTSIESKTKFSVQVPFFAKGEEELKVGLDVTYNRESTDTAENTQEFTIPEQTLLAQPGGTTRLIYTVQSTAFSGTYNTKAIFKQKQGGEAKKIVDGKEIEGKELEKWNEEQGYYFIKGLLEDKPEFGIKAPEFGDIFVFDDVNKKVYLKDGVFTFEGQAGHQSTAEAVFIPDDNTKPEVKMPLAEYNRRVANGISLYAK

SEQ ID NO: 76 - protein, 333 aa, Bacillus thuringiensis
MRKYKKLAVVVPLAGMLMSGAGVLGGATSAHADGIKIDGVRTGGQISGNQIAADHYQQFLNAIGEEGEADNFEIVAMPDSGPKNIHITEAKPIDAPENTTEVMSYHNITGIQQSLKTPSKKITHKNTLAIKNGGSIKTSIESKTKFSVQVPFFAKGEEELKVGLDVTYNRESTDTAENTQEFTIPEQTLLAAPGGTTRLTYTVKSTAFTGTYNTKALFKQKQGGKAKKIINGKELEGKELENWNEEQGYKFIKYLLEPKWGQKAPEFGDIFVFDDANKKVYLKDGVFTFEGQAGHQSTAEAVFIPDDKTKSEVKMPLAEYNKRVANGISLYAK

SEQ ID NO: 77 - protein, 327 aa, Bacillus thuringiensis
MENDAKSINQKGNRAENREVSIKAEELNLEQILHKIGNAPIGQLINYDYTLYLHYNTTIWKEDPFHPFPVSPKLAPTSGNLPSPAKYAKLDGLQLKDVKLVANPADLFTTFKPFYMAVGNFENKTSNQQTYQTIEFSEAITDSTTITKTKSLKTGTEVSTKAELDVFGLGGVEVTAKVTVEGTWSDSNAETKTTTRTLRIPPMSVLVDPGKGVRVQAEVLKGELKNVNLKANALLQGSYIWHNHSHEYKGDIYGFLKTIQITHNKQFNEITGGGILFDDASKSTIAQGLSLLSADVTSSSYRVVLEEYDLKTGNTTKTTPIKTYQLK

SEQ ID NO: 78 - protein, 325 aa, Bacillus thuringiensis
MKNNKKKKQILSLAMLASIGTSLGIISPDSVSAAQTNPIQNTIQEQRNVSISDWRTPIQDTYKAAKLSSPNRFLSNEARLERLQIYQSSVEADGSPTITDSKSLFVGKTTLTNRSNQDQILTTNQFSKTFENSITNSTTHGFNFGVSTSATFGIKFLGETNVEISTEYNFSNTVAKTKTESYTYTATPQNIVVPANSSVEVIVTLNTNKISGNVKLLTHVDGEVRYQNNPANLGSWRIEKFKGFLGSIHPKDISNNLKAHPQNGVYVIGTGNYSAEYGTEFSVTVRPVTNLNTSPAKSSSMVSENSKATNEGYTYTVKPEVKKEQ

SEQ ID NO: 79 - protein, 509 aa, Bacillus thuringiensis
MVIYNNRKNGIDSPSIRSSYPNFVDSHGQLTIDRNGFNVNQSIQYTNRNWMNYIPDSHKISELSIPGTHDSMALYGPLDPIPVPIGDEATITQTMNLDIQLNSGIRYIDIRCRHYYDSFQIYHGPVFQHASFNDVLVSVKSFLTQNPRETILMRVKEEIEDLTPPVGNTRSFAETFKSYVRGNEKYFWDFLKSQNPYNPTLGEARGKIILLQHFDANIFLGIPWYSLEPNVHDMWQLDGRGQLYAKWEMVREHFFKAMRNRNQIYFTHLSGTSKLPVIGEPKPWFVASGYGGPQNTNLPRQLSGPSSQWPDNPRSPTSGFVHYGGTNVLSTRRIRERTFTHTGIVIADFPGKGLIDGTIALNFSGTLSGDFQIVTALNNSSVVDLNVGSRNVTLYENNKENHQRWNFTYDRSENAYVIHSVSNTELALAWDTSSPNRNVFATSIGSLRQNEYYWILEQIGNYIYIFKNKKDTNMVLTVVGGIQPGTNLQVYPKAIGSAQTNQTFVLKFI

SEQ ID NO: 80 - protein, 683 aa, Bacillus thuringiensis
MGGTYMNQYNNDGYEIIDSNTSPYPTNRNNQYSNSRYPYTNNPNQSMQHTNYEDSLIVSQNIQQYNSCADNSSSTDWTPIISTGLIVGGTLLSALVAPVAIPVGIGAVLISVGTVLPILWPGGTNDNNRNWENFILQGSAVTCEVITTVVKDLVNTALNGLKQQYHFYNDALKYWKANPNDVNAKNNVQQIFISLYQSTIDKMSIFSMQGYETLLLSAYTGAALLQITLLAEGIQYADQWGLARNSGDFYRDQLYKSISKHIEHCEIWYKNGLNKLKSRPNIRWGAITNYRREYTLSVLNIIATFPAFDLRVYPLKEQIGLQAEFTQELFTISPDVQNFQNLPTILNLENELIPRPDLVRHLKRLSFFTRTTAGNLNNYLESITNESYRTNNNSTHLDNYGNFNNQNQGSNLTLTNPDQVIYFADILHHAYYNPPTIFGTYGIRAIDFKIGTNRQISQTLRYSSNTNPGGSIHQIYAPFPPTTQSTNLTNYQYILSRITMTKESYPIWGIGTFESTKIYGFNWIHASLNLTNSISSINPIGKKKITQISAVKAFDIDGGSVIEGPGHTGGNLVELKRSNYIKISCKIIDSAVYNLRIRYTSNTATAETNGIRITVIDKINKRTSNYALKNTIRNPQRPTSYDNFEYLNIETFSFYGTDPNIEIMLENMSSGIITIDKLEFTPQ

SEQ ID NO: 81 - protein, 1295 aa, Bacillus thuringiensis
MNINDNKDEFEIMGNGSMVYQPRYPLAQAPGSEFQGMNYKDWMNRCANGELGELFVDSDAVRNGIVAGLGVTSFVLSIGFPAAAAAVGIISVLLPLLWPDQAGPPGTTEAQFTWDQWITAGEELAAQTVSTSVKDRAIDTTRILQSRMRDYQQAICNLQTDPDNEEYKADVRREFNDAEDQAKDAVIQFGNLNYAIPLLADYAEAANLHLLLLRDVVKFGEIWGFTALQVQQYYSNTGVGNPGMKQLLATYTDHCVRYYKEGLEKRYATGNWNAFNDYRRTMTIMVMDIVSLWPTYDSRVYTLPTKSQLTRTVYTPFVLSYPTPNLPLISEIESQVVVPPSLFSWLFLIESYTEKAAQDKECLTGQRQAFAYTTGRDLFQEFKGNLNGTYRGQLVAEPGLGQYVWAIELYGSGYLWDGYPYLHNLGFFNFKLTNSEDQKIHVSPGDIVDGTTAILGLPCKPNNNDCDPCNPCNTLPINLSNPCNDISLYSHRFSYLGTYPAPPVNNWSPTNIGNFSFGWTHISADYENQIDAEKITQIPAVKADGMGSTVKIIKGDGSTGGDLVQLGQGPSHATFLKIPMGGIAQKGYQLRIRYALSAREDSELVVERLVGNRGDMVRDYYASTWMTPTYSGDPLQVNYDSFGYATFESLLPPTPYSNWELIFAGDTALIDKIEFIPIEGSVEEFEANQALEKARKAVNALFTNDAKNALQLKVTDYAVDQAANLAECVSDEFHAQEKMILLNQVKFAKRLSHVRNLLNHGDFELSDWSSENGWKTSPHVHVVSNNPIFKGRYLHMPEATSSHFSSNTYPTYVYQKVDESKLKSYTRYLVRGFVGNSKNLELLVERYGKDVHVEMNVPNDIQYSLPMNECGGFNRCKPASYQARPLHTCTCNDTAVTHTNCQCKDKGNRNSTNMYTNAPTDSAVYRNGSHDHKSCGCKNNDMYQSGTHPHKSCGCKDPHVFTYHIDTGCVDQEENLGLWFALKIASENGVANIDNLEIIEAQPLTGEALARVKKREHKWKQEMAQKRLHTEKSVQAAQTAIQNLFTNTQYNRLKFETLFPHIVHADLLVQQIPYVYHDYLLGSIPPVPGMNYEMYQQLSVKIGNAHALYEQRNLVRNGTFSSGTGSWHVTEGVEVQPLQNTSVLVLSEWNHEASQQLRIDPDRGYVLRVTARKEGSGKGTVTMSDCADYTETLTFTSCDYNTIGTQTMTGGTLSGFVTKTLEIFPDTDRIRIDIGETEGTFKIESVELICMEQMENHLYDMAGNLEEEMLDLQSARSGSSTLDHICSTLIGDFGC

SEQ ID NO: 82 - protein, 1258 aa, Bacillus thuringiensis
MNQNYNNNEYEMMGTGGMDYQPRYPLTNAPGSEFQQMDYKDWMDMCTNESVGDVFGDTANAVRDGLIIGTGVAWALLGLIPVVGGPASAIAGLFNVLLPYWWPEQAGAPGTPQAQFSWNQLMTAAEEMVDKKILESKRGEATARWQGIQLLGRDYYSALCDWINDQDNAVKKERLRDAFDDLDDQLKLAMPFFSVQGFELPMLSMYAQAANMHLLLLRDVVQNGVSWGFAPYEVDRYYFDPSGQRSPGLLQLLGIYTNYCVEWYEKGLQEQYNTGRWEKFNNFRRNMTIMVLDTVAIWPTFDPRRYPLPTKSQLTRTLYTNPVGRGGYRENMDSLENDLVAPPQLFTWLREIEIPVGIVYLDDRAPLLCKQTLQRTLSSTTWSITQGEITTPVIDTLTLTIENPYYQDDVWKVNTHGISGGTDTVTGWTFNFIKSPDQTLMVNNNIHPGSVTDRWSGFPCRGNDSVICDPCDFENTCRKETPNTSVPCDDKQHYSHRLSYVGAQGGRRDVSTPFELIRFGYGWTHVSADNNVLDEKKITQIPAVKGYLTNGTVIKGPGSTGGNLVKLSENDDLNINVAVLPPSGSALVYGYNIRIRYASSAETRLLVEQVFDDNGPYIYNIPSTSSADSLTYQSFSYYDLSFHHIGPGIIETPTSSSLFFQNSGGGDIIIDKIEFIPRNTPGAEYEANQAVEKARKAVNALFTNDAKNALQLNVTDYAVDQAANLVECVSEEFHAQEKMILLDQVKFAKRLSQTRNLLNYGDFESSDWSGENGWRTSPHVQVASDNPIFKGRYLHMPGARSPQFSNNTYPTYAYQKVDESKLKSYTRYLVRGFVGNSKDLELLVERYGKDVHVEMDVPNDIRYTLPMNECGGLDRCKPASYQTRTPHTCTCKDTAVTHTDCQCKDKENRTSTNMYTNVPTGSEVYTNGFHAHKSCGCGDKHMDKNGTHPYKSCGCKDPHVFTYHIDTGCIDMEENVGLFFALKIASENGVANIDNVEIIEAHPLTGEALARVKKREQRWKQERDKKRLETDKAVQAAQKTIRGLFTNTQQNRLKFETLFPQIVDAEMLVQQIPYVYHDYLLGAIPLVPGMNYEIYQQLAASIGNAYALYEERNLLRNGAFRSGTGHWHVTEGVKVQRLQNSSVLVLSEWSHEASQQVRIDPDRGYVLRVTARKEGGGKGTVTMSDCAAYTETLTFTSCDYNTSGSQTMTSGTLSGFVTKTLEIFPDTDRIRIDIGETEGTFKVESVELICMELMEDHL

SEQ ID NO: 83 - protein, 684 aa, Bacillus thuringiensis
MNQNNNNEYEIIDSKNLPCPSNRNIDYSRHPFTNNPNQPLQNTNYKNWINMCQKNQQYGENLETFASADTIAGVSAGVIVVGTMLGAFAAPITAGLIISFGTLLPIFWKPGEDPKTVWQAFLKIGNRPFSSPVDQALIDLLSNKARSLESQFNDFQRYFDIWNNNKTPGNAGEVLRRFSSLDADIIRELEQLKGNYYITVLPGYAQVANWHLNLLRIAAFYYDQWASSSNLSIQSIYPEDYINDLQTCLTNCAIESGNKISSKYYKCVLKCRINEYINYCSKTYQEGLNILKNSSGVKWNEYNTYRREMTINVLDLIAVFPNYDPDKYLISTKSQLTREIYTDALIDAFANAHFNINDIENSLTRPPGLVTWINRLDFYTGKFPGDVPGLTANSINYSFTNGNSNDSPIYGYRLSGDSRNPVQIPLNQYVYNMLITYLSNSPSVIQKIDFNLNNQQTRIYDTGLTLSPIYQSTINLSLPGKDRSFPPKFNNYTHFLSYVKTAPGDERPSSSRARNVCFGWMHFSVNDYDVLAGGYNIIFDTIITQIPAVKARHLPLPSFVMPGPGHTGGNLVVLSTQIEFQCIVLNPVSYKIRMRYVAYSPNRSINLTVSIRSEIGNYQNIVPNISSTVQSPEDTKNPKYEHFQYLDISIPLELFGITNITITRSDSISNNTLIIDKIEFTPDV

SEQ ID NO: 84 - protein, 760 aa, Bacillus thuringiensis
MEECGRYMANENSTNNPDTNNNPIYNENQNENYGDTNGYSSEPGVNDTNVYSNDTSGYANDTNANTGDYNTGTINSSEMNNDTYNSGNVNYLVENPGLLEEVPQVPYNVVAKPLYLQTDEETEEAWRIWESRDPSIFIPALVGIIGSMLLKKVAGLIIDRALKKLYGYLFPGDAPITMLDILRAVEELVNQRIEVAVRQLVEAELEGLQRAVKSFEDDVATFESSQSPSFMEEITKVIQTEEAIRTGEELPTPTAIIDSVNRLNATFAQAIPKFRLPDWKNQSLPLYAQAANLHLFFLRDVIDNAQKWGLTTSEINRYKNDLKNYIQEYSNYCISTYKAEFDRRFQNTRFDKALEFRNFMTLNVLDYVGIWSMLRYSNVVINSSMNLYNTTCRLALPLASWNYLNAMMQGRPNKILLALGTGRLETYHPLIPGPTPGSIAIPAETSNRYFYTGTHYINGNSTGTVGLIPLPDSPGSLFTKWEKSIPAFYVTDPVRSPWIVANLTRTITSSSRERVDNESIRFSSRRGDPGTQYPDYYIRNVTGLPNRLSDPYPDIVNGFWNKKTTTAQIGVTATFNRTIISAHTNNGSIKHIVPYVADETNLAVPKPRGFTILPLQHDWAYNGDGSNNLLRFSEKFGNNGDAISIPTAAGGSKHVRFNYKIDNTGSTDVSYDVYLKVATVGAGTTNFFVAKNGTGYGKNISTATSNDGITDNGVKFKDILIYPNISIPKNTQVTLEITVSGSAAYLGQIIFVPRGVTPIY

SEQ ID NO: 85 - protein, 1522 aa, Bacillus thuringiensis
MHQNRNIRGGLYMNYNNNEYEILDNGNIGYQPRYPLVNSPGAEFQQMNYTDWMNRCNYGESGEVFSSARDGVIIATGIGWAILGFIPVIGPGLSAAAGVLNVILSYLWPEDAGAPGTEVAQISWNRILRTVEGLIDTALSSVIKTVATTELRDLQEDIISYNLALCNLKTDPNNETYKTTVRREFDNAADQARKTILAMSPITPDQPAETKKNAILLLADYAQAANLHLLLLRDVIQYGESWGFSPLEVQQYYDNPSGRSGMKQRLEEYTNYCVNWYNVALSDIRASGVYFDNKWRQFNAFRRDMTIMVLDIVSLWPTFDPRLYPVSTKSQLTRTVYTDPIGIGSSSGIDFTTVPFDLVESSIVAAPKLFSWLRKQEFSFKDWADVYPIAGYKMTFQNTLSAALWEGSFIGTRDLSYVVEKQTLTIPDPQLNDDIWQIGTNSDSVRGTVYGWYFPFTQSPDQYIGSPDLDRKILSGLPCKGNNPSICAPCQSENSCNGGPLNTTNPCNDKQMYSHRFSYMGAGARELAAPYNSLTFFGYGWTHISADPNNLIDAEKITQIPAVKASSISGDARVVRGPGSTGGDLVKFSAPSNTFTNIGLWTTIPAGIRAYRVRIRYASNADIPLDVLISRTGYGTFIAPATTTDLNNLAYNKFGYLDTLVFMSDEPNEQYEQDINFSLNQVADSGTLILDKIEFIPMEESLEEYEANQALEKARKAVNALLISDAKDALKLNITDYAVDQAANLAECVSEDFHAQEKMILLDQVKFAKRLSHARNLLNYGDFESSDWSGENGWRTSHHVSVRSDNPIFKGRYLHIPGATSSQFSSHVYPTYIYQKVDESKLKSYTRYLVRGFIGNSKDLELLVERYGKDVHVEMDVPNDIQYTLPMNECGGFDRCKPASDQARLSHTCTCNDTAVTHTDCQCKDKGNRTSTNMYTNVPTGSAVYRNGSHDHKSCGCKNNDMYQNRTHPHKSCGCKDPHVFTYHIDTGCVDQEENLGLWFALKIASENGVANIDNLEIIEAQPLTGEALARVKKREQKWKKEVAKKRLETERAVQAAQGAIQPLFTNAQYNRLQFETLFPQIVRAEKLVQQIPYVYHPFLSEALLAVPGMNFDIVQQLSALVDRARGLYDLRNLVQNGTFSSGTGNWHVTDGITTHPEGNTSVLVLSEWNHEASQQLRIDPDRGYVLRVTARKEGAGKGTVTMSDCADYTETLTFTSCDYNTIGTQTMPGGTLSGFVTKTLEIFPDTDHIRIDIGETEGMFKVESVELICMEQMEDHLYDMADNLEKEMRYLQSSNLPIPCAPGSSTAVGDMNCQCEKLGHDSYENKLKHYCKCKDFDTDRPVYRESSVACINNVNFNTRETNVLLDVNGNPVLSGRDYYLLNRYTENKGGGATQVSWWRPSIDEYLGTQAQGEEPFNTKFMFFRETMGYGNTLPLNSRLLIHVPENPKWYAIDCTFGVCLAARTNAYSELWTPLTSSTSLPGTFQFQNYGSSQFLGSDGPNTWLYANKSILGEINFEIVPV

SEQ ID NO: 86 - protein, 1275 aa, Bacillus thuringiensis
MNLNDNKNEFEILDSGNLSYQPRYPLANVPGYELQNMGYKGWRDMCPDAKRQLLGQVGISPYDDTETLGKVLAITTGIVAALAGVAATAFPPLAAVSGVFGIISMILDVLWPESDSQVVWGQFAGAAEALVGRRISDEIKKSADIQLRIAQSRLKDYQQASCNLQRHPNNEVYKELIRDAFDDADDALKDTIKIFSREGYELLLLLNYVQVANLHLLLLKDVVRFGVGWGFPQQRVEQYYSNPTNLGSPGMVQLLAEYTNHSTSFFWQGVREKEEQTRDYYWNQEKYDGYRSDMTMMVLDMIAIWPTYDPRRYPYATEVQLTRNVYSTVIGAQFNQPQNGWYMMPIEYTWDAPPRLVRWIQEFNGYTWKNVSSLAQYAGTKINYKYTTGGSTFWESRGIIPSDGDGRVWSTYYLYSNFVKARRVGGGVYPKYELAIMDMVFPDSGGGYFTFGGGSAPSYFETYYAPPCENRPINANNPDVCTPNEWLNAPTGACLSKGLKSHMLADVIPGHWLIDSSVADKPFISTFAFAWRSTLCEDFNTVQPDKIGQFPAVKANWLSNDGARVVRSSGNTGGDLVRLNGAAVLKMDVQFSERRIYIIRIRYATIADDFGLNVVVRNNGDIYNDSTIFRLNPTSNNSTTQWTFENYGYQDVGSLYPNPDLGFYNVSVSTQGALDSHMDIDKIEFIPIEESLEEYLANQDIEKASKAVNALFTSDAKNALKLNITDYAVDQAARLVECVSKEFYAQEKIILLDQVKFAKRLSRTRNLLNYGDFESPDWSGENGWKTSSHVHVASDNPIFKGRYLHMPGANYSRFDNKVFPTYVYQKIDESKLKPYTRYLVRGFVGNSKDLELLVERYGKDVHVEMDVPNDIQYTLPMNDCGGFDRCQPVSHQTASPHTCTCKDTTVAHTDCQCKDKGNRTSTGMYTNGHHSHKSCGCKGPHVFSYHIDTGCVDQEENLGLWFALKVASENGVANIDNLEIIEAQPLTGEALARVKKREQKWKQEMAQKRLQTDKAVQAAQGAIQPLFTNAQYNRLQFETLFPQIVNAEMLVQQIPYMYHPFLSGALPTVPGMNFEIIQRLLAVTGNARGLYEQRNLVRNGTFSSGTGNWHVTEGVKVQPLQNTSVLVLSEWNQEASQQLHIDPDRGYVLRVTARKEGGGKGTVTMSDCAAYTETLTFTSCDFNTSGSQTMTSGTLSGFVTKTLEIFPDTDRIRIDMGETEGTFQIESVELICMEQMEDDLYDMAGNLEEEMLDLGIENINAVTNKMCFSWDIQCP

SEQ ID NO: 87 - protein, 1304 aa, Bacillus thuringiensis
MRNLIDVPVFLDQVIKKIRGGLYMNINDNKNEYEILDSGNLSYQPRYPLARAPGSECQKPNAKDGIYTPVGRVDTALQNIDIGLSIRTALSILQMLLSVSFPALGRAAGLINIIFGFLWGTLAGQSVWEKFMRAVESLVNQKITDAVRVKALSELEGVQNALELYQEAADDWNENPTDVSNKERVRRQFTSTNTTIEYAMPSFRVPTFEVPLLTVYAQAANLHLQLLRDAVKFGNEWGMPSEEVEDMYNRLTRRTAEYTDHCVATYDKGLKEAYDLAPNPTDYNKYPYLNPYSKDPIYGKYYTAPVDWNLFNDYRRDMTLMVLDIVAVWPTYNPRIYTNPNGVQVELSREVYSTVYGRGGSNNSSFDAIESQIVRPPHLVTELTNLKIEQGATLDMEQIQYPKYMKVTNTLHYVGSSSTWEQSSSAIPIRPITQIHTIPANNIGNLSLSQLDVPYRFSFYNKDDALIAAVGAEFPPNTVTWNGIPKAEDSNQNSHHLSYVGALGTQSSAGFPWTYPTELLGEWGFGWLHNSLTPTNEILSDKITQIPAVKGYLLERGAKVVKGPGSTGGDLIQLPGASQGRITINISNAFQKSFMVRIRYAATADGQLKFGRISSDGGIHSTSTKYVTTGANENVNSLTYNRFKYTDVYGAMASNIYSGIVLINEMGGSIYIDKIEFIPIKGSLEVFEAEQDLENARKAVNALFTGAAKDVLKLNVTDYAVDQASNLVECVSDEFHAQEKMILLDQVKFAKRLSQARNLLNYGDFESSDWSGENGWRTSHHVSVRSDNPTFKGHYLHMPGAMSPQFSHNIYPTYAYQKVDESKLKSYTRYLVRGFVGNSKDLELLVERYGKDVHVEMDVPNDIRYTLPMNECGGFDRCKPASHQTGSPHTYTCKDTAVAHTDCQCKDKENRTSTNMYTNVPTDSAVYMNGSHTHQSCGCKNKNSDRYQSGTHPQKSCGCKDPHVFSYHIDTGCVDQEENLGLWFALKIASENGVANIDNLEIIEAQPLTGEALARVKKREQKWKQEMAQKRFQTDKAVQAAQTAMQALFTNAQYNRLKFETLFPQIVNAEMLVQQIPYMYHPFLSGALPTVPGMNFEIIQRLLAVTGNARGLYEQRNHVRNGTFSSGTGSWHVTEGVEVQPLQNTSVLVLSEWSHEASQQVRIDPDRGYVLRVTARKEGAGKGTVTMSDCADYTETLTFTSCDYNTVGTQTMTGGTLSGFVTKTLEIFPETDRIRIDIGETEGTFKIESVELICMEQMEDHLYDMAGNLEEEMLDLQSARSGSGTKLIPPLTFSDCYTNNEYCY

SEQ ID NO: 88 - protein, 1283 aa, Bacillus thuringiensis
MNQYDNKNEYEIICSDGIYGQPRYPFTKAPGSELQQMNYKNWLSRCQNENIGFTPEEEAVKTALIISTGLAWALLAVIPGINVGVTVGAGAAAAAGVLNVLIPFLFPDQTVDNQPAPPQYTQKELMKSVEALTRKEIQESKRVDALARWEGIQTMGRDYYAALCALSKDPDNEEKKFAVRDSFDDVEDQLKLSIPYFRAQGFEIQMLAMYAQAANLHLTILRDVVRYGKGWGFSQERIDEYYDSQGSARNPGLLQLLSVYTNHCVNWYNVGLSQEYGTGNWNRFNDFRRNMTIMVLDIVAAWPTYNPRLYPLPTESELTRTVYTDLLGNTGGTGLTTEGSQPIGIIEENVTVRPQLFRWLRSLDMGAIDGVQTTVLKGGQQKFETTGSSTIIDEGWKGDIEIGMKFQEHNSLYWPMSPVATKFFKGAVTGFAFGLIDLGRYRYLFFFMASVHLPPGGSYFSGLPCRPEGNSDCEDPCSPDCIKETLPGSQAICIDPNFLSSHRLSNVGFGMLTANDPQFVTPGTKFAAYFSYGWTHASAKSGNVIAREKITQIPAVKGYKFHQSARVIKGPGSTGGDLVKLDVNGGFYIQVVTARSETVSGYTIRLRYASKAEIPLLFRITDPDYGNSMQIPDLPATTSDDNLTYTAFNYYNMGIRLEASATSKEIIIFMQNLSAEDALILDKIEFIPMEESLEEYEANQGLEKARKAVNALFTSDAKNALQLNVTDYAVDQTVNLVECVSDEFHAQEKMILLDQVKFAKRLSHTRNLLNYGDFESPDWSGENGWKTSPHVHVAADNPIFKGRYLHMPGATSSQFSGNVYPTYIYQKVDESKLKSYTRYLVRGFVGNSKDLELLVERYGKDVHVEMDIPNDIQYSLPMNECGGFDRCRPASYPTSPSHTCTCKDTASMHMDCQCKDKVNRPSADMYTNIPTGSTGYANGFHAHKSCGCKNNDMYPNGKHPHKSCGCQDPHVFTYHIDTGCVNQEENVGLFFALKIASENGVANIDNLEIIEAQPLTGEALARVKKREHKWKQEMVQKRLETERAVQAAQGAIQPLFTNAQYNRLKFETLFSQIVHAEKLVQQIPYVYHPFLSGVLPAVPGMNFEIVQHLLAVIGNARALYEKRNLVRNGTFSSGTGSWHVTEGVKVHPLQNTSVLVLSEWNHEASQQVRIDPDQGYVLRVTARKEGAGKGTVTMSDCAAYTETLTFTSCDYNTVGSQTMTGGTLSGFVTKTLEIFPDTDRLRIDIGETEGTFKVESVELICMEQMEGHLYDMAGNLEEVQNLT

SEQ ID NO: 89 - protein, 802 aa, Bacillus thuringiensis
MTKNHKKILSMTLVTSMLAGTYIPTAYTAFAETEQKEGSQENQTGPINKGSLPLDSYGLFENPYKGVTFDQFMNAFNNNTWNPLLVDIKNKGNAGSGTLTFLKGIMGTGLSLLPPPASLLGSVWNVFMPTTATNGTDMWKQLETYIEEKIDGKIKEYHKYLMGAEFNGAMTAIKEYQRVLQIYNDSKNSLARVEEPGTPVIEAVRAADRKLKEFIAIIQTPENKADSVYQQITAPIFVQAANAHLLLQRDIILYGNEWGMDKGQWEGYQANQKKLIQEYTNYAMQVYNDGLEKRKKEAEQINTLEKYRNTDRWNHINKYVREYTLSVLDFVELFPYTDPSKYSRGTIQNNSRQIYSDIGGKIQPKERTWQDIQKILDSQEYKGDLKRLDIRSADRIDAIRAHYSERLFDATPWATTGWIGNTTGGNLKEIPSYDDPLTKVTVGSEITPFYLHLDHESGKTYSRFGSTLSGKGTASTFEYPGQKISLVHAFNRSTQPGFDGIDAIVFGFSNKNLSLKYQLATNMITTIPAEMYNLGSGFGTQVEPIHAQQKAMKTDTLNSYLRYDVKTPKTQKYKIKYRVSANESSKIRLLYNNNLVEETSIPVINNIAADTIKGEYGYYKTIEGPTVEIKAGEAVSNRLQIENGQGKFSLDHIELEPLESDEVVAQDNFDDRRLNWNNIKSIVTEGITGNAGTIGPNGDTWTYINNQLVGNSRYTLSMKVKLNSNDANVRQKVTVFTDNKNHQRVTKTVELKGGAGFQEIKLEFATDKLMHLVGLDTHIGIQTSNGNSDVLFDDVKVIGAKK

SEQ ID NO: 90 - protein, 574 aa, Bacillus thuringiensis
MKYKTRKDAKRKYKQAFLATVATMTLGVSTLGNNTSAFAAEEDNISVISSHTLNDVGIQVEKIIPDKTLREKFLKTFATKDTTKVGINGAFQFIKDAQKDVPNFNDTFRTLAMASTELIPYAGMVISPLIGLLWSEEGGVSAQIMEMRKQILTLIDQKFDNEYVNNLKTDFKTLNSNILTLEKSLNSNSNTNAVYYAGNDIYTTRGNWANHIQHSFESLIDRASSNHEVASLPLYTNLAVAHITFLKYMHEHAKGPKLKYDEQSLQHFFDKGNLEVITKKYADHIKKTYDQGLQTFNKDLNELDEKIKERTNLLQTPVNGLGKELKLKTLNTKIKELEDKHLQTNKQNFIALTWGDSTLQAILQGEWKLDNNALSFIDKKGVKKTDWLQLGTNWYYLNPEKSEIKNSAGDIFKSGEMVTGKIDIKGKTYYFKPGTGEMKTGWVKDGDKWYYFSPKNDNKNYDGNTFNEGEMMTGWVKVANEYFFLATEKGNQNDNNDKENAVIFNKGEMMTGWIYVKDGIATKESNSGGAWYYLNDKPEYGTIGHMLHDIKASVRNKEGKYIEYKFGEDGKMKW

SEQ ID NO: 91 - protein, 520 aa, Bacillus thuringiensis
MKYKDRTSVKRKYKQALLATVATMTFGVSTLGSSASVFAAENAEALQDTTDSLGAGGGADLEQQWKEMAKELGDHHSPSLQAKGVAELLSKGAFSVYKDAHSNKGNFNNTFRTLSMGISEYFPYGKLVISPLIGLLWPETVSTQNNQFESLINQMSSLMDQKIEDFDLATIKRQLEALKKEMQVFERLVNSKILTEGFYSAGSPEESARTKAAHLQATFHELISLCQKNNLSEAELPLYTKIANIHLLFLDFMDKNWNKSKLQIDQKSFDALYADDIKNAAQKYAQHIHDTFILSNQKIDKKLSNIAEGSNHQTTLEWLRTKLVSLGNDLELKKQGKSGSSNRSLAAVQRDYNAFEEKYDKYRDLLNKKSTYQESTVDDPGFHAALGKWKKESTEWYFLDMHGEKQTGWALSWNSKYYYLSTKDTDSNTDGDTFKKGQMWTKWMKDANGNWYYFSPTTKDGYQEGQMWTGWMKDANGNWYYFSPTTEDGYQEGQMISGKTISISGKEYNFDTNGVCTNPN

SEQ ID NO: 92 - protein, 350 aa, Bacillus thuringiensis
MMFMPLVPQESFENDKKNLNTHVLHYSSNQLVDIGQGDVVNAPLPKLSNNPIDTPPSTGTAITKNPLNLQDYLTLTVTSTNIKSATDVRDAIIGILASFFLYKNNNIPSPFHSIVDESNLNKLIFYDSERNNFLDLGSSNPAPPGENNICFYISIPSHIVKRDLLNESYVIRTTQYKYLDGSLQDRTISTDWKKTITTGSSKTTTWGLTATQGMELSWTEGGFPLPASAEQKITLSLEESYGQSNEYSTETSIEKNYHFDKPGSDYKYDQYRYAIYQLSTSYKLKDGCTLMNDLQNLNTVFGPGKFNANGKYFTLKFNISDVLVPENTIYATQTPDPTPSSLSLIQKMNI

SEQ ID NO: 93 - protein, 341 aa, Bacillus thuringiensis
MGIYNEHENYFINQDKTILFYDKTSPNYLIEQSKNILEHGFIPELSKDPFDKIPLTSKSIHSSQINATDFLTLTLRSARDYPKGITNSLWNELLLICRKLVAYFFHSNMDIPILYNSYGIEIDLDRIMIAKPLNTIFKNEILLYISLPNKYLKHSSENIQLMKYTSYKLLDSGLQDAKMETHWSQFITSGLNLNTLCEFLTVIGFEITNISEKTVIPTSIEQKIRNYLNYIFNTNNTYITNQIKRKSYILKSVSSNYIYDKYAYAIYQLTTEYKLIVKNNLQNILTKINTAFKQEILFQQHFGNIKLEIPQQYIVEADNLCIIRTPDPIVSKEYHSIQIMI

SEQ ID NO: 94 - protein, 331 aa, Bacillus thuringiensis
MEKSPNTNFLSCVVIKGGIRMAITDVQSSAADFMNWAIPYYLNGTVTAQQFYPYVIKNPIAVPEQLFFVTIPVQKVASVQVIENNTSLTQSQTLKFSEKAIETTTSSTTEGYKVGSGITSTSKFSYTTKIFGSSIGLEQTFTVNVNSEYNHSSTETTTQTTERLWKVTQPVSVLPYTRIVATLTIMGGEVEIPMTLNANLLGQGLDTEYYCGADFSSPDYPNAWQPFMASNLYDTSWPNKPASFAGGNGNELILKGASITTNGPSLYSTVHFEQTPLPGYERLSEPKSWYSNEVVLRDGTMITIPDLDPATGRVLPSKMPEPILASSRIND

SEQ ID NO: 95 - protein, 315 aa, Bacillus thuringiensis
MAITDIRSASEDYLRWHAQYYWGGATLQTMGFYPYLVQNPIAVPDQTVFEVVPVQKISAVQVLTNDSDQEQTQIVDFSEKIIETTTSTTTEGYKIGSGITSTSKFGYSLKILSTTTGFDQTFTLNTTSEYNHSSTETTTQTTERLWELTQPVRVAPRSQVISTLTVFGGKAEIPMTLNANLLGQGVSNGAPEVYSDLTLRKTDGSTWYNWVYASQMYDLAWTGKPVSFAGYTGHSLILKGAAVTTTGPCLYSTVRFDETPLPGYEKDSKPRSWYSNEVLLRDRTIITIPDLDPKTGRPLPPKGPEPILVSSRIND

SEQ ID NO: 96 - protein, 311 aa, Bacillus thuringiensis
MIMITNIEQSTINYMIWYATHYLHANPNTFYNIGLYPYEIHNLSIVPKFNRITVNPSQKDTVIQTIENNTDVEQHRIIEFYEKTTENITNRTTAGYSIYEGIKSTFTCNIQVNFIISGGLEESLEIPVHSECKCYETETTNTTCSKLWKVKQNVMIPPHSRINASLIIMGTNIKIPMQLSANIKGTHVHNNKSNYFSSLSFQQHDGSKVRAQFCASNLSQDAWPNKPASFRSPGPYSSLNLKGDAITTIEPGLYAMIRFEQLPINGYSREGKIWYSDQIILRDGREIRLPNFDLLTGKASCIDVDMTIIGN

SEQ ID NO: 97 - DNA, 2016 bp, Artificial Sequence
  synthetic nucleotide sequence encoding a toxin protein
atgtcgccaaacaaccaaaatgaatttgacatcattgatgttccaagcaacatctccgtcagcaacagcttcgtcagatatccatttgcaaatgatccaaacaggacgctgcaaaacaccaactacaaggacttcctcaccatgtcagagaagagcaacagcggctacctcacagatccagaagcatttgatgatgttggcagcgccatcttcgccggcctgagcatcaccgccaagatcatggatgcttttgatgttcctggaggagacatcttcaatgggctgctggagatcatcggcatcttatgggatcttcaagatgacacctgggaggccttcatggagcaggtggaggtgctcatcgaccagaagattgctgaatatgcaaggaacctggcgctcacccatctaaaagggctggagaacagctacaagctctacctggaagctcttgctgattggaagcagaaccccacctcgccaagcagccaagaaagggtgaggacaaggttcagagacacagatgacagcctcaccgtgttcatgccctccttcgccgtcaaaggatatgaagttcctctactggccgtctatgctcaagctgccaacctccacctgctgctgctgagagattctgttgcatatggcctcggctggggcctctcccagctcaatgtcaatgacaactacaaccgccatgtccgcctcactggagaatacaccaaccactgcgtcagctggtacaccaccggcctggagaagctccgcggctcaaatgctcaaagctggatcaagttcaacagatacaggagggagatgacggtgatggtgctggacatcgtcgccctcttccccaactatgatgcaagaagatatcctcaagcaacaacaacagagctgacaaggctcatctacacagatcctcatggctacaccatctactctccaacaagccaaaccaccatcccctggtatgaatatggccagagcttctcagagattgaaaatgtggccatccaagctccaaggctcttcagatgggcgcaggagatgcaaatctacaccaagtttgtgaggcatgctcctcaagaaagccactactgggcggcgcacaccttcagcttccaccacacaagggacaacaccaagaccaccttgacatatggtgacaccagcaaccccatctctgttggaacagcagatctttcagatctggacatctacaaggtgagcagcttggtggccagcagctggggcagcggcgtccgcctgctggtcaccaaggccaagtttgaggtgatctacaccttcaaccagctctgggagttcaactacgagcctcctggcatcagcaacttcttcaaccaatggaagaacaccgacacagagctaccaatccagattgttgatcctccaacatttggagatccaaaccagtacagccaccgcgtcgcctacataagccatgctcccatccagccatacagcggcgccttcagaaactatggcctggtgccggtgtttggatggagccatgtttctgtggacaggaacaacaccctctatgctgacaggatcacccagatccccgccgtcaaggccgtgcagctctcaggagaaccttatcctgtggtgagaggacctggcttcactggaggagacattgcaaggctgccaaacaacccaaatgttggcctcctcttcaacagcaaggtggagagcccttctgagaacaagagatacagggtgaggatcagatatgcctgcgcctcaggagcaagggccatcttcggcggcctctacctccccatcaccgtgcagttcaaccaaacaatgagcaccaccacgccaacaagatatgaagattttcaatatgttgatgtctcaggaaccttcatcctcggcaacaccaatgtcagcttctccttggtgccgcagagcgccaaccaaacaaacaacctcttcatcgacaagatcgagttcatcccagagaacccggcgctggaagcagaaagc

SEQ ID NO: 98 - DNA, 2016 bp, Artificial Sequence
  synthetic nucleotide sequence encoding toxin protein
atgtctccaaacaaccaaaatgaatttgacatcattgatgttccaagcaacatctccgtcagcaacagcttcgtcagatatccatttgcaaatgatccaaacaggacgctgcaaaacaccaactacaaggacttcctcaccatgtcagagaagagcaacagcggctacttgacagatccagaagcatttgatgatgttggaagcgccatcttcgccggcttgagcatcaccgccaagatcatggatgcttttgatgttcctggaggagacatcttcaatgggctgctggagatcattggcatcttatgggatcttcaagatgacacctgggaggccttcatggagcaggtggaggtgctcatcgaccagaagattgctgaatatgcaaggaacctggcgctcacccatctaaaagggctggagaacagctacaagctctacctggaagctcttgctgattggaagcagaaccccacctctccaagcagccaagaaagggtgaggacaaggttcagagacacagatgacagcctcaccgtgttcatgccatccttcgccgtcaaaggatatgaagttcctctacttgctgtttatgctcaagctgcaaacctccatctgctgctgctgagagattctgttgcatatggccttggatggggcctctcccagctcaatgtcaatgacaactacaacaggcatgttcgcctcactggagaatacaccaaccactgcgtcagctggtacaccaccggcctggagaagctccgcggctcaaatgctcaaagctggatcaagttcaacagatacagaagagagatgacagtgatggtgctggacatcgtcgccctcttccccaactatgatgcaagaagatatcctcaagcaacaacaacagagctgacaaggctcatctacacagatcctcatggctacaccatctactctccaacaagccaaacaaccatcccatggtatgaatatggccagagcttctcagaaattgaaaatgttgccatccaagctccaaggctcttcagatgggctcaagagatgcaaatctacaccaagtttgtgaggcatgctcctcaagaaagccactactgggctgctcacaccttcagcttccaccacacaagagacaacaccaagacaacattgacatatggtgacaccagcaaccccatctctgttggaacagcagatctttcagatctggacatctacaaggtgagcagcttggtggcaagcagctggggcagcggcgtcaggctgctggtgacaaaggccaagtttgaggtgatctacaccttcaaccagctctgggagttcaactatgaacctcctggcatcagcaacttcttcaaccaatggaagaacaccgacacagagctaccaatccagattgttgatcctccaacatttggagatccaaatcagtacagccaccgcgtcgcctacataagccatgctcccatccagccatacagcggcgccttcagaaattatggcctggtgccagtttttggatggagccatgtttctgtggacaggaacaacaccttgtatgctgacaggatcacccagatccctgctgtcaaggctgtgcagctctcaggagaaccttatcctgtggtgagaggacctggcttcactggaggagacattgcaaggctgccaaacaacccaaatgttggcctcctcttcaacagcaaggtggagagcccttctgaaaacaagagatacagggtgaggatcagatatgcttgcgcctcaggagcaagagccatcttcggcggcctctacctccccatcaccgtgcagttcaaccaaacaatgagcaccaccacgccaacaagatatgaagattttcaatatgttgatgtctcaggaaccttcatcctcggcaacacaaatgtcagcttctccttggtgcctcaaagcgccaaccaaacaaacaacctcttcatcgacaagattgagttcatcccagaaaacccggcgctggaagcagaaagc

SEQ ID NO: 99 - DNA, 894 bp, Artificial Sequence
  synthetic nucleotide sequence encoding toxin protein
atgaagaaggccatcttctccctgctggccaccaccatgagcttggggatgatcctctctcctgttcctcaaaatgtcaaggccgccgagcagagcaagatctccgtctaccaagatcttggagaaagggtgaagaagatggcgcagagcgccgcgctctctggatcagcatatggccaccacaccatcagagatgctgagctcactggaaggaacatcgagagctccatgacagagaacagcgagctgctcaccattggagaaaacatcctggagaacaacctcggccatgatgccaccctgccaacatcaggctatgagcacttcttcgaggacaagacctccaccaccaacaccaccggctggacatttggctacaacttctccgccaccctctccgtgctgatggcctccgccacccacaacttcagcgtggactacaacatgacaacagcaagaactgaagaaaaaacacaaagaaggaccttcacccttccttcacaacctgttcctgttcctgctggaaaaacatacaaggtggagtacaagtttgagaaggtgagcatctctggaaggaaccagctcaatgccaacctctatggagatgtcacctactactacaacaaccagccgctgagcccccagctgctgtattcagctcttggaagagctgctgacacccaaggatttgaaaggatcatcagggacactgtttctggaaatgacagatttggcatccgcgccaccggcatcggcctcttcaagacagaatttggaacaaggctcttcgcctccatcaccgacatcaccaacccgcgctcgccggtgaagattgaaacaaaaaccatcccggtggagttcaagaccatctcagagaacacaagggtggtggag

SEQ ID NO: 100 - DNA, 894 bp, Artificial Sequence
  synthetic nucleotide sequence encoding toxin protein
atgaagaaggccatcttctccttgctggccaccaccatgagcttggggatgatcctctctcctgttcctcaaaatgtcaaggctgctgagcaaagcaagatctccgtctaccaagatcttggagaaagggtgaagaagatggctcaaagcgccgcgctctctggatcagcatatggccaccacaccatcagagatgctgagctcactggaagaaacattgaaagctccatgacagaaaacagcgagctgctcaccattggagaaaacatcctggagaacaaccttggccatgatgcaaccttgccaacatcaggctatgagcacttcttcgaggacaagacaagcaccaccaacaccactggatggacatttggctacaacttctccgccaccctctccgtgctgatggcctccgccacccacaacttcagcgtggactacaacatgacaacagcaagaactgaagaaaaaacacaaagaagaaccttcacccttccttcacaacctgttcctgttcctgctggaaaaacatacaaggtggagtacaagtttgagaaggtgagcatctctggaagaaaccagctcaatgcaaacctctatggagatgtcacctactactacaacaaccagccgctgagccctcagctgctgtattcagctcttggaagagctgctgacacccaaggatttgaaaggatcatcagggacactgtttctggaaatgacagatttggcatcagggccaccggcattggcctcttcaagacagaatttggaacaaggctcttcgcctccatcaccgacatcaccaacccgcgctcgccggtgaagattgaaacaaaaaccatccctgtggagttcaagaccatctcagaaaacacaagggtggtggaa

SEQ ID NO: 101 - DNA, 2076 bp, Artificial Sequence
  synthetic nucleotide sequence encoding toxin protein
atgaacagctatgagaacaaatatgagctgctggatgcttctcaaaacaactacaacatcagcaacagatatttgagatatcctctcaccaacaaccctcaagattcaatgaagcacaccaactacaaggactggctggccatgtgtgaaaattctcctcaatatgatgtcaaccctgctgagatcaacagcagctcagtctccacggcgctgaagatcctcggcaccttggtgaagttcatcgagaagattgaaggaattgggccggtgttcaccgcgctctccgccatcctgccggtgctctggccgccaaacacgccgacgccggagcgcgtctggaatgatttcatgacaaacactggatcattgattgatcaaactgtcaccaccgaggtgaggaaccaagcaaatgccatgatggctgatgtcaaggagaacctctacagatacaccagcagcttcaatgcatggaagggcacgccgaccaacaaccccaactaccccaactacctcgccgccgtcatcagagaatttgggctggtggaggccaagctgaggagcgccgccgcctacttctcaaacagggtgggatatgagctgctgctgctgcccatctacacccaggtggccaacagccacctgctgctgatcagagatggcctcatcttcgccaatgaatggagcttggcaagaagtggagatgagctctacaaggagttctacagatacacctcaatctacatcagccatggcatcaagtactacaatgaaggcctcaacaccttgaagaacagaaatgttccatggggcaccttcaatgactacaggagggagatgaccatccagatcctggacatcatgagcctcttctcaagctatgatgcaaggaaatatcctgctgacaggacagacaccaccatcctccccaagacagagctgacaagggagatctacagcgcgctgctggattcacctccaaacaagcccattgctcagctggaggagagcttgacaagagatgttcatctcttcacctggctgaagaatgtggagttctggaccttcaactacaacatgtatcctgacacaagatatctctccgccaacaggattggcttcagctacaccaacagcagcgccatccagccttctggcatctatggatcaacagcatttggcacggcgctcacccacagcttcccgctgaacagcaatgtctacaggatctccaccaaggacaccaccgccgtgccaaatcaagtcaccaacattgatctgaacctcatcaatggaacatcagctctctacaacagcggcatcatccctgttccaaacaacctccgcaccaccctcttcggcttcagcagcaatgaaagcaggccaaaccagcccaccatccaggactacacccacatcctctcatacatcaagacagacatcatcggcggccacagaagcagggtgagcttcgcctggacccacagaactgttgatccaaacaaccagatcctcaccaacaacatcacccagatccctgctgtgaagagctcactgctgaacactcaagcaagggtgatcaaggggcctggccacactggaggtgatctggtggccatcaccagcaatggaacacaaagtggaaggatggagatccagtgccgcgcctcaaacttcatcgagccagacagaagatacaggctgaggatcagatttgctgccaacagcaacctgctggtgaatgtcacctacacctcaaatggcatcccgcgccaaactcccttcaccaccaacctcatccccgccaacaatgagatgttcttccctggcaacaccatccctgctgatctgaaatatgaatacttctactacagggagagcttcgacaccatcctccccatgagggtgacatcaggagagctcatcaccgtcgccatccagccaacaaacatgctgagcaaccagatcctcatcatcgacagggtggagttcatccccatcacccagagcgtgctggactacacagaggagcagaacctggagacagctcaagctgtggtggacaacctcttcaccaac

SEQ ID NO: 102 - DNA, 2076 bp, Artificial Sequence
  synthetic nucleotide sequence encoding toxin protein
atgaacagctatgaaaacaaatatgagctgctggatgcttctcaaaacaactacaacatcagcaacagatatttgagatatcctctcaccaacaatcctcaagattcaatgaagcacaccaactacaaggattggctggccatgtgtgaaaattctcctcaatatgatgtcaaccctgctgagatcaacagcagctcagtttccacggcgctgaagatcctcggcaccttggtgaagttcattgagaagattgaaggaattgggccggtgttcaccgcgctctccgccatccttcctgtgctctggccgccaaacacgccgacgccggagagggtctggaatgatttcatgacaaacactggatcattgattgatcaaactgtcaccacagaggtgaggaaccaagcaaatgccatgatggctgatgtcaaggagaacctctacagatacaccagcagcttcaatgcatggaagggcacgccaacaaacaaccccaactaccccaactacctcgccgccgtcatcagagaatttgggctggtggaggccaagctgaggagcgccgccgcctacttctcaaacagagttggatatgagctgctgctgctgcccatctacacccaggtggccaacagccatctgctgctgatcagagatggcctcatcttcgccaatgaatggagcttggcaagaagtggagatgagctctacaaggagttctacagatacacatcaatctacatcagccatggcatcaagtactacaatgaaggcctcaacaccttgaagaacagaaatgttccatggggcaccttcaatgattacagaagagagatgaccatccagatcttggacatcatgagcttgttctcaagctatgatgcaagaaaatatcctgctgacagaacagacaccaccatcctcccaaaaacagagctgacaagagagatctacagcgcgctgctggattcacctccaaacaagccaattgctcagctggaggagagcttgacaagagatgttcatctcttcacctggctgaagaatgtggagttctggaccttcaactacaacatgtatcctgacacaagatatctctccgccaacaggattggcttcagctacaccaacagcagcgccatccagccttctggcatctatggatcaacagcatttggcacggcgctcacccacagcttccctctgaacagcaatgtctacaggatctccaccaaggacaccaccgccgtgccaaatcaagtcaccaacattgatctgaacctcatcaatggaacatcagctctctacaacagcggcatcatccctgttccaaacaacctgaggaccaccctctttggcttcagcagcaatgaaagcaggccaaaccagccaaccatccaagattacacccacatcctctcatacatcaagacagacatcatcggcggccacagaagcagggtgagcttcgcctggacacacagaactgttgatccaaacaaccagatcctcaccaacaacatcacccagattcctgctgtgaagagctcattgctgaacactcaagcaagggtgatcaaaggacctggccacactggaggtgatctggtggccatcaccagcaatggaacacaaagtggaaggatggagatccaatgccgcgcctcaaacttcatcgagccagacagaagatacaggctgaggatcagatttgctgcaaacagcaacctgctggtgaatgtcacctacacatcaaatggcatcccaaggcaaactcccttcaccaccaacctcatccctgccaacaatgagatgttcttccctggaaacaccatccctgctgatctgaaatatgaatatttctactacagggagagcttcgacaccatcctccccatgagggtgacatcaggagagctcatcaccgtcgccatccagccaacaaacatgctgagcaaccagatcctcatcatcgacagggtggagttcatccccatcacccaaagcgtgctggactacacagaagagcagaacctggaaacagctcaagctgtggtggacaacctcttcaccaac

SEQ ID NO: 103 - DNA, 1527 bp, Artificial Sequence
  synthetic nucleotide sequence encoding toxin protein
atggtgatctacaacaacaggaagaatggcattgattctccaagcatcagaagcagctaccccaacttcgtggacagccatggccagctcaccatcgacagaaatggcttcaatgtcaaccagagcatccagtacaccaacaggaactggatgaactacatccctgacagccacaagatctcagagctctccatccctggaacacatgacagcatggcgctctatgggccgctggaccccatccctgttccaattggagatgaagccaccatcacccaaacaatgaacctggacatccagctcaactcaggcatcagatacatcgacatcagatgccgccactactatgacagcttccagatctaccatgggccggtgttccagcatgcttccttcaatgatgtgctggtttcagtgaagagcttcctcacccaaaatccaagagaaaccatcttgatgagggtgaaggaggagattgaagatctgacgccgccggtgggcaacacaaggagctttgctgaaaccttcaagagctatgttcgaggaaatgagaagtacttctgggacttcttgaagagccaaaatccatacaaccccacccttggagaagcaagaggaaagatcatccttctacaacattttgatgccaacatcttcctcggcatcccctggtacagcttggagccaaatgttcatgacatgtggcagctggatggaagaggccagctctatgcaaaatgggagatggtgagggagcacttcttcaaggccatgaggaacaggaaccagatctacttcacccacctctcaggaacaagcaagctgccggtgattggtgaaccaaagccatggttcgtcgcctctggatatggaggacctcaaaacaccaacctgccgcggcagctgagcggcccaagcagccaatggccagacaacccaagaagccccaccagcggcttcgtccactatggaggaacaaatgttctctcaacaaggaggatcagagaaaggaccttcacccacaccggcatcgtcattgctgattttcctggaaaaggcctcattgatggcaccattgctctgaacttctccggcaccctctctggagatttccagatcgtcaccgcgctcaacaacagctccgtggtggacctcaatgttggatcaagaaatgtcaccctctatgagaacaacaaggagaaccatcaaagatggaacttcacatatgacagatcagaaaatgcatatgtgatccacagcgtcagcaacacagagctggcgctggcctgggacacctcctcccccaacagaaatgtttttgccacctccatcggcagcttaaggcaaaatgaatactactggatcttggagcagattggaaactacatctacatcttcaagaacaagaaggacaccaacatggtgctcaccgtcgtcggcggcatccagcctggcaccaacctccaggtgtaccccaaggccattggatctgctcaaacaaatcaaaccttcgtgctgaagttcatc

SEQ ID NO: 104 - DNA, 1527 bp, Artificial Sequence
  synthetic nucleotide sequence encoding toxin protein
atggtgatctacaacaacaggaagaatggcattgattctccaagcatcagaagcagctaccccaacttcgtggacagccatggccagctcaccatcgacagaaatggcttcaatgtcaaccaaagcatccagtacaccaacaggaactggatgaactacatccctgacagccacaagatctcagagctctccatccctggaacacatgacagcatggcgctctatgggccgctggaccccatccctgttccaattggagatgaagcaaccatcacccaaacaatgaacctggacatccagctcaactcaggcatcagatacatcgacatcagatgccgccactactatgacagcttccagatctaccatgggccggtgttccagcatgcttccttcaatgatgtgctggtttcagtgaagagcttcctcacccaaaatccaagagaaaccatcttgatgagggtgaaggaggagattgaagatctgacgccgccggtgggcaacacaaggagctttgctgaaaccttcaagagctatgttcgaggaaatgagaagtacttctgggacttcttgaagagccaaaatccatacaaccccacccttggagaagcaagaggaaagatcatccttctacaacattttgatgccaacatcttcctcggcatcccatggtacagcttggagccaaatgttcatgacatgtggcagctggatggaagaggccagctctatgcaaaatgggagatggtgagggagcacttcttcaaggccatgaggaacaggaaccagatctacttcacccacctctcaggaacaagcaagctgccggtgattggtgaaccaaagccatggttcgtcgcctctggatatggaggacctcaaaacaccaacctgccaaggcagctgagcggcccaagcagccaatggccagacaacccaagaagccccaccagcggcttcgtccattatggaggaacaaatgttctttcaacaagaaggatcagagaaagaaccttcacccacaccggcatcgtcattgctgattttcctggaaaaggcctcattgatggcaccattgctctgaacttctccggcaccctctctggagatttccagatcgtcaccgcgctcaacaacagctccgtggtggacctcaatgttggatcaagaaatgtcaccctctatgaaaacaacaaggagaaccatcaaagatggaacttcacatatgacagatcagaaaatgcatatgtgatccacagcgtcagcaacacagagctggcgctggcatgggacacctcctcgccaaacagaaatgtttttgccacctccatcggcagcttaaggcaaaatgaatactactggatcttggagcagattggaaactacatctacatcttcaagaacaagaaggacaccaacatggtgctcaccgtcgtcggcggcatccagcctggaacaaacctccaggtgtaccccaaggccattggatctgctcaaacaaatcaaaccttcgtgctgaagttcatc

SEQ ID NO: 105 - DNA, 2349 bp, Artificial Sequence
  synthetic nucleotide sequence encoding toxin protein
atgaaccaaacagatgtgatgaatgtcatccaagctgctgaaattgaaggcatcaagaggagccaggagaagtaccccaacagggagctctccgtgttccagcacaatgttctctccggcaacctctatgccaacctcaagcagccgacgctggtgacatcaactgacatccaagaaacaaacaccgtcaactgcaaatgcagcttgaagaaggctcctcatgttgttggaaggaacatgagcttgtcaagctgcttggagcaatgtggagatctggacctccagatccaggccattgatcttcaaactggcatcggcacggcgctctccatcacctccatcctggtgaaccctggagttggcagcgccttcgccctcatcaggaccatccttcctctcctctggccatcacaatctcaagatccaaacaaggtgtggcagagcatgatggcaacagctgaagagctggtggatgccaagatcgacaccgtgatgaggaacctcgccatctcaaagctcaatggcatcaagagcttgatcgactacttcaatgatctcatctccatccttgctcaagatccaaacaacaccaacaagagagaagctgtgctggatgcctacagagatgtagatcgcgccttcattgaatcaatgccgcagtttgctgttcctggatgggaaacccagctgctgccagtttatgctgaagctggcaacctccacctcctcttcctcagagatgctgtcaagtttggatcagaatggaacatgaaccaatgggagattgatctcaactacaagtacctcaaggacaacatcaagagctacaccaaccactgcgtcaactggttccacaccggcctcaagaggctcaacccagaaacaaatccttcacacaagccggccaacatgagagattgcaccaaatatccatggattgcatatgatcagtactgggaggtgaacccaacaagagattgctcgccgacgctgctcacctccatctgcgaggagaaaacaaatgaatcaccgccgcaggtggcctccatctatggctacagaggctacagagaaagctctggagaatatcaagggctggagaactggaacctctacaacaacttcagaagggacatgaccatcatggtgctggacatcctaccagcatggccaacatatgatcctcagctctaccctgacatcggcatcaagacagagctgacaagggaggtgtacacccagatcagaggaacaacatacagaagctcagcaagccagaacaccatctccgccattgaaagcaggatgatcaggccgccaagcctcttcacctggctcaccaagctggacttccagcagatccatgtcacctcgccgacgccgggccaagatcctggatatccctacaccgccggcaacctgctggtgggaggatcacagagcttgatgtacaccctcggcgacagctttgaggagaacttcggcaagattggcaccctgccggtgaaaactgtcaacctcacgccggacaattccatcacccagttccaaacaaagcaatggtttgagccaagggagattgctctctacaagagagatgctcatctcttcaccttgggcaccatagaagaaaagacgccgcacttctcaaggacgccgggctgcttctacaccaaggaatgcatctatgatccaaccctccgcgtcaaccagatgcccaaggccattgatccaaacaacccaaatgctccttcttcagattggaaggacagccacagcttgagctacttcaaatatgagccggtgagatcagattctccatatggaaatccaaatgatggccagatcggcgccgtgctgtttggatggacccacatcctggtggaccccaagaacaagctggagagcgacaagatcacccagatccccgccgtcaaggcttcagaaggaacaaactaccaggtcatcaaggggccaggcttcactggaggtgatctggtgaacctcaagacatatggaagcctcaacatcagcttgacagttccaatgccaagcctcaactacaggctgaggatcagatatgcaagcaaggagcagaagaggatcaggctgaggatcttgaggaacaatgtttggtcagaatatggagattttgacatccccaccacctacagcggcaaccagctgaccttcgacagcttcaagatcttcaccgtcagcaccgtgctcttctcctccacctccatcctctacatcgagaggattgatcccttctccgagctgctcaccatcgacaagatcgagctcatccccatcaccggcagcgtggaagaatatgaagcaaatcaa

SEQ ID NO: 106 - DNA, 2349 bp, Artificial Sequence
  synthetic nucleotide sequence encoding toxin protein
atgaaccaaacagatgtgatgaatgtcatccaagctgctgaaattgaaggcatcaagagaagccaagagaagtaccccaacagggagctctccgtgttccagcacaatgttctctccggcaacctctatgccaacttgaagcagcccaccttggtgacatcaactgacatccaagaaacaaacaccgtcaactgcaaatgcagcttgaagaaggctcctcatgttgttggaagaaacatgagcttgtcaagctgcttggagcaatgtggagatctggacctccagatccaggccattgatcttcaaactggcattggcacggcgctctccatcacctccatcctggtgaatcctggagttggaagcgccttcgccctcatcaggaccatccttcctctcctctggccatcacaatctcaagatccaaacaaggtttggcaaagcatgatggcaacagctgaagagctggtggatgcaaagatcgacaccgtgatgaggaacctcgccatctcaaagctcaatggcatcaagagcttgatcgactacttcaatgatctcatctccatccttgctcaagatccaaacaacaccaacaagagagaagctgtgctggatgcctacagagatgtagatcgcgccttcattgaatcaatgcctcaatttgctgttcctggatgggaaacacagctgctgccagtttatgctgaagctggaaacctccacctcctcttcttgagagatgctgtcaagtttggatcagaatggaacatgaaccaatgggagattgatctcaactacaagtacctcaaggacaacatcaagagctacaccaaccactgcgtcaactggttccacaccggcctcaagaggctcaacccagaaacaaatccttcacacaagccagcaaacatgagagattgcaccaaatatccatggattgcatatgatcagtactgggaggtgaatccaacaagagattgctcgccgacgctgctcacctccatctgcgaggagaaaacaaatgaatcaccgccgcaggtggcctccatctatggctacagaggctacagagaaagctctggagaatatcaagggctggagaactggaacctctacaacaacttcagaagagacatgaccatcatggtgctggacatcctaccagcatggccaacatatgatcctcagctctatccagacattggcatcaagacagagctgacaagggaggtgtacacccagatcagaggaacaacatacagaagctcagcaagccaaaacaccatctccgccattgaaagcaggatgatcaggccgccaagcctcttcacctggctcaccaagctggacttccagcagatccatgtcacctcgccgacgcctggccaagatcctggatatccctacaccgccggcaacctgctggtgggaggatcacagagcttgatgtacaccctcggcgacagctttgaagaaaactttggcaagattggaaccttgccggtgaaaactgtcaacttgacgccggacaattccatcacccagttccaaacaaagcaatggtttgagccaagagaaattgctctctacaagagagatgctcatctcttcaccttgggcaccatagaagaaaagacgccgcacttctcaaggacgccgggctgcttctacaccaaggaatgcatctatgatccaaccctccgcgtcaaccagatgccaaaggccattgatccaaacaacccaaatgctccttcttcagattggaaggacagccacagcttgagctacttcaaatatgaaccagtgagatcagattctccatatggaaatccaaatgatggccagatcggcgccgtgctgtttggatggacccacatcctggtggaccccaagaacaagctggagagcgacaagatcacccagatccctgctgtcaaggcttcagaaggaacaaactaccaagtcatcaaggggccaggcttcactggaggtgatctggtgaacctcaagacatatggaagcctcaacatcagcttgacagttccaatgccaagcctcaactacaggctgaggatcagatatgcaagcaaggagcagaagaggatcaggctgaggatcttgaggaacaatgtttggtcagaatatggagattttgacatccccaccacctacagcggcaaccagctgaccttcgacagcttcaagatcttcaccgtcagcaccgtgctcttctcctccacctccatcctctacattgaaaggattgatcccttctcagagctgctcaccatcgacaagatcgagctcatccccatcaccggcagcgtggaagaatatgaagcaaatcaa

SEQ ID NO: 107 - DNA, 2019 bp, Artificial Sequence
  synthetic nucleotide sequence encoding toxin protein
atgtcgccaaacaaccaaaatgaatttgacatcattgatgttccaagcaacacctccatctccaccaacttcgtcagatatcccttcgtcaatgatccaaacagcaacaccctccagaacaagaactacaaggacttcctcaccatgtcagagaagagcaacagcggctacttgacagatccagaagcatttgatgatgttggcagcgccatcttcgccggcctctcaatcaccgccaagataatggatgcttttgatgttcctggaggagacatcttcaatgggctgctggagatcatcggcatcctctgggatcttcaagatgacacctgggaggccttcatggagcaggtggaggtgctcatcgaccagaagattgctgaatatgcaaggaacctggcgctaacaaacctcaaggggctggagaacagctacaagctctacctggaagctcttgctgattggaagcaaaatccaacatcaccaagcagccaagaaagggtgaggacaaggttcagagacacagatgacagcctcaccgtgttcatgccctccttcgccgtcaaaggatatgagatcccgctgctggccgtctatgctcaagctgccaacctccacctgctgctgctgagagattcagcagcatatggcctcggctggggcctctcccagctcaatgtcaatgacaactacaacaggcaggtgcgcctcactggagaatacaccaaccactgcgtcagctggtacaccaccggcctggagaagctgagaggatcaaatgctcaaagctggatcaagttcaacagatacaggagggagatgacggtgatggtgctggacattgttgctctcttccccaactatgatgcaagaagatatcctcaagcaacaacaacagagctgacaaggctcatctacacagatcctcatggctacaccatctactctccaacaagccaaaccaccatcccctggtatgaatatggccagagcttctcagagattgaaaatgtggccatccaagctccaaggctcttcagatgggcgcagaagctccagatctacagcaagtttgtgaggcatgctcctcaagaaagccactactggagcggccacaccttcaccttccaccacacaagagatgacaccaagacctccttgacatatggagacatcatcgactacaagtacctctcagaagcagatctctccaacaccgacatctacaaggtgagcagcttggtggccagcagctggggcagcggcgtccgcctgctggtcaccaaggccatctttgaaaccatcaacaccagcaacaagctgattgattatgaatatgatctccagctgctctcaaacttcttcaatgaatggaagaacacagaagcagagctgcccatccagatcgtcaaccctcccatcttcggcgacttcaaccagtacagccaccgcgtcgcctacataagccatgctcccatccagccatacagcggcgccttcagaaactatggcctggtgccagtttatggatggagccatgtttcagtggacaggaacaacaccatctatgctgacaggatcagccagatccctgctgtgaaggctgttcaaggaagcggcgagccatatcctgtggtgcgcggccctggcttcaccggcggcgacattgcaaggctgccaaacaacccaaatgttggcctctggttcaactcaaaggtggagagcacggcgctcaacaagaggttcagagtgagaatccgctatgcctgcgccaccggcgcgcgcgctgattttggaggcctcaccctccccatcaccgtgcagttcaaccaaacaatgagcaccaccacgccaacaagatatgaagattttcaatatgtggacatctcaggcagcttcctcctcaccaacaccaacagcggcttctccttggtggcgcagagcgccaaccaaacaaacaacctcttcatcgacaagatcgagttcatcccagagaacccggcgctggaagcagaaagc

SEQ ID NO: 108 - DNA, 2019 bp, Artificial Sequence
  synthetic nucleotide sequence encoding toxin protein
atgtctccaaacaaccaaaatgaatttgacatcattgatgttccaagcaacacctccatctccaccaacttcgtcagatatccatttgtcaatgatccaaacagcaacaccctccagaacaagaactacaaggacttcctcaccatgtcagagaagagcaacagcggctacttgacagatccagaagcatttgatgatgttggaagcgccatcttcgccggcctctcaatcaccgccaagataatggatgcttttgatgttcctggaggagacatcttcaatgggctgctggagatcattggcatcctctgggatcttcaagatgacacctgggaggccttcatggagcaggtggaggtgctcatcgaccagaagattgctgaatatgcaaggaaccttgctctaacaaacttgaaggggctggagaacagctacaagctctacctggaagctcttgctgattggaagcaaaatccaacatcaccaagcagccaagaaagggtgaggacaaggttcagagacacagatgacagcctcaccgtgttcatgccatccttcgccgtcaaaggatatgagattcctctgctggctgtttatgctcaagctgcaaacctccatctgctgctgctgagagattcagcagcatatggccttggatggggcctctcccagctcaatgtcaatgacaactacaacaggcaagttcggctcactggagaatacaccaaccactgcgtcagctggtacaccaccggcctggagaagctgagaggatcaaatgctcaaagctggatcaagttcaacagatacagaagagagatgacagtgatggtgctggacattgttgctctcttccccaactatgatgcaagaagatatcctcaagcaacaacaacagagctgacaaggctcatctacacagatcctcatggctacaccatctattctccaacaagccaaacaaccatcccatggtatgaatatggccagagcttctcagaaattgaaaatgttgccatccaagctccaaggctcttcagatgggcgcagaagctccagatctacagcaagtttgtgaggcatgctcctcaagaaagccactactggagcggccacaccttcaccttccaccacacaagagatgacaccaagacctccttgacatatggagacatcatcgactacaagtacctctcagaagcagatctctccaacaccgacatctacaaggtgagcagcttggtggcaagcagctggggcagcggcgtcaggctgctggtgacaaaggccatctttgaaaccatcaacaccagcaacaagctgattgattatgaatatgatcttcagctgctctcaaacttcttcaatgaatggaagaacacagaagcagagctgcccatccagattgtcaatcctcccatctttggagacttcaaccagtacagccaccgcgtcgcctacataagccatgctcccatccagccatacagcggcgccttcagaaattatggcctggttcctgtttatggatggagccatgtttcagtggacaggaacaacaccatctatgctgacaggatcagccagattcctgctgtgaaggctgttcaaggaagtggagagccatatcctgtggtgcgcggccctggcttcaccggcggcgacattgcaaggctgccaaacaatccaaatgttggcctctggttcaattcaaaggtggagagcacggcgctcaacaagaggttcagagtgagaatccgctatgcttgcgccaccggcgccagagctgattttggaggcctcaccctccccatcaccgtgcagttcaaccaaacaatgagcaccaccacgccaacaagatatgaagattttcaatatgtggacatctcaggcagcttcctcctcaccaacaccaacagcggcttctccttggtggctcaaagcgccaaccaaacaaacaacctcttcatcgacaagattgagttcatcccagaaaacccggcgctggaagcagaaagc

SEQ ID NO: 109 - DNA, 1137 bp, Artificial Sequence
  synthetic nucleotide sequence encoding toxin protein
atgaagttcctctccaagaaggccatgacagggctgctggtgggcgccaccaccctctccatctgggcgccggcctcagaagctgctccagcaaacaaccagtactacagcatcaacctccaggccaaccagaacctggtgtgggatgtctcaggaagcctggagctgccaggaaggcccatcaagaacaaggacatcatcttgagcaatgccaacaacaatgacaatcagcagttcgccttcttcccgctggatgatggaagatatgccatcgtgaacaagaacagcggcaagagcgccattggatttgatgaagctctgctggatgtttcatgggatggctcgccggcgcagcaatggtatctccgcgacaaaggaagcaacaactatgagatcgtcaaccaaggaaatggcaaggtggcaagctatggcaagctctacacccccatccccgcctccatccaggagatagtggatctggatgacagcaacccttcagatccagacagggtgttctacatcggcaacagcctcagcagcttcgagctgccgacgctgccggccaccggcaacaggccagatgctccaaactacaccggcagcgtcgaccagcagctgcctcaaacaagcaactcagtggtggtgggcgcctccttgatcccctgcatcatggtgaaggacagccaagcatctgattacaccaagatccacaacagcccctactacaccttggtgaaggaggagtactgggacaagaccttctcagctgtcatccctgctggcatcacaaggacctacagcttcaagacagggatgacctccgtggaccagcagaagatgacagacaccctctccatgaagattggagcagattttggcctcaaatatggagattcaacagcttccttgaagagtgagatctcaaggaccattcaaacagagatcacctccaccgacacagaagcatcagaagaaactgtcaacagcaccgtcaccagcgagcctggaaaaacaacaggcttcaccgagtaccagctggccaccaagtacaccttgaagagagctgatggaagcattgtttcagatccatggatcgtcaagaacaacaagatcaccgtggcaaggaagaatgctcaa

SEQ ID NO: 110 - DNA, 1137 bp, Artificial Sequence
  synthetic nucleotide sequence encoding toxin protein
atgaagttcctctccaagaaggccatgacagggctgctggtgggcgccaccaccctctccatctgggcgccagcttcagaagctgctccagcaaacaaccagtactacagcatcaacctccaagcaaaccaaaacttggtttgggatgtctcaggaagcctggagcttcctggaaggcccatcaagaacaaggacatcatcttgagcaatgcaaacaacaatgacaatcagcagttcgccttcttccctcttgatgatggaagatatgccattgtgaacaagaacagcggcaagagcgccattggatttgatgaagctctgctggatgtttcatgggatggctcgccggcgcagcaatggtatctgagggacaaaggaagcaacaactatgagattgtcaaccaaggaaatggcaaggtggcaagctatggaaagctctacacccccatccctgcttccatccaggagatagtggatcttgatgacagcaatccttcagatccagacagggtgttctacattggaaacagcctcagcagcttcgagctgccgacgctgccggccaccggcaacaggccagatgctccaaactacactggaagcgtggatcagcagcttcctcaaacaagcaattcagtggtggtgggagcttccttgatcccctgcatcatggtgaaggacagccaagcatctgattacaccaagatccacaactctccctactacaccttggtgaaggaggagtactgggacaagaccttctcagctgtcatccctgctggcatcacaagaacatacagcttcaaaacagggatgacatctgtggatcagcagaagatgacagacaccctctccatgaagattggagcagattttggcctcaaatatggagattcaacagcttctttgaagagtgagatctcaagaacaattcaaacagagatcacctccaccgacacagaagcatcagaagaaactgtcaacagcaccgtcacctcagagcctggaaaaacaacaggcttcacagagtaccagctggccaccaagtacaccttgaagagagctgatggaagcattgtttcagatccatggattgtcaagaacaacaagatcaccgtggcaaggaagaatgctcaa

SEQ ID NO: 111 - DNA, 2034 bp, Artificial Sequence
  synthetic nucleotide sequence encoding toxin protein
atgaaccagtacaacaatgatggatatgagatcatcgacagcaacacctcgccatatccaacaaacaggaacaaccagtacagcaacagcagatatccatacaccaacaaccccaaccagagcatgcagcacaccaactatgaagattcattgatcgtcagccagaacattcagcagtacaacagctgcgccgacaacagcagcagcacagattggacgcccatcatctccaccggcctcatcgtcggcggcaccctcctctcagctctggtggcgccggtggccatccctgttggcatcggcgccgtgctgatctccgtcggcaccgtgctgcccatcctctggcctggaggaacaaatgacaacaacaggaactgggagaacttcatccttcaaggaagcgccgtcacctgcgaggtcatcaccaccgtggtgaaggatctggtgaacactgctctaaatggcctcaagcagcagtaccacttctacaatgatgctctcaagtactggaaggccaacccaaatgatgtcaatgccaagaacaatgtgcagcagatcttcatctccctctaccagagcaccatcgacaagatgagcatcttctccatgcaaggatatgaaaccctgctgctctccgcctacaccggcgccgcgctgctccagatcaccctacttgctgaaggcatccaatatgctgatcaatgggggctggcaaggaacagcggcgacttctacagagatcagctctacaagagcatcagcaagcacatcgagcactgcgagatctggtacaagaatggcctcaacaagctgaaatcaaggccaaacatcagatggggcgccatcaccaactacaggagggagtacaccctctccgtgctgaacatcattgccaccttccctgcttttgatctccgcgtctacccgctgaaggagcagatcggcctccaagcagagttcacccaggagctcttcaccatctcaccagatgttcagaacttccagaacctccccaccatcctcaacctggagaatgagctcatcccaaggccagatctggtgcgccacctgaagaggctctccttcttcacaaggaccaccgccggcaacctcaacaactacctggagagcatcaccaatgaaagctacaggaccaacaacaactcaacccacctggacaactatggcaacttcaacaaccagaaccaaggaagcaacctcaccttgacaaatccagatcaagtcatctacttcgccgacatcctccaccatgcctactacaacccgccgaccatctttggaacatatggcatccgcgccatcgacttcaagattggaacaaataggcagatctcacaaaccttgagatacagcagcaacaccaaccctggaggaagcatccaccagatctatgctcccttcccgccgaccacccaaagcaccaacctcaccaactaccagtacatcctctcaaggatcaccatgaccaaggagagctaccccatctggggcatcggcacctttgaaagcaccaagatctatggcttcaactggattcatgcttctctcaacctcaccaacagcatcagcagcatcaaccccatcggcaagaagaagatcacccagatctccgccgtcaaggccttcgacattgatggaggatcagtgattgaaggacctggccacaccggcggcaacctggtggagctgaagaggagcaactacatcaagatcagctgcaagatcatcgacagcgccgtctacaacttgaggatcagatacacctcaaacaccgccactgctgaaacaaatggcatcaggatcaccgtcatcgacaagatcaacaagaggacaagcaactatgctctgaagaacaccatcagaaatcctcaaaggccaacatcatatgacaacttcgagtacctcaacattgaaaccttctccttctatggaacagatccaaacatcgagatcatgctggagaacatgagcagcggcatcatcaccatcgacaagctggagttcacgccgcag

SEQ ID NO: 112 - DNA, 2034 bp, Artificial Sequence
  synthetic nucleotide sequence encoding toxin protein
atgaaccagtacaacaatgatggatatgagatcatcgacagcaacacctctccatatccaacaaacaggaacaaccagtacagcaacagcagatatccatacaccaacaaccccaaccaaagcatgcagcacaccaactatgaagattcattgatcgtcagccaaaacattcagcagtacaacagctgcgccgacaacagcagcagcacagattggacgcccatcatctccaccggcctcatcgtcggcggcaccttgctctcagctctggtggcgccggtggccatccctgttggcatcggcgccgtgctgatctccgtcggcaccgtgctgcccatcctctggcctggaggaacaaatgacaacaacaggaactgggagaacttcatccttcaaggaagcgccgtcacctgcgaggtcatcaccaccgtggtgaaggatctggtgaacactgctctaaatggcctcaagcagcagtaccacttctacaatgatgctctcaagtactggaaggcaaatccaaatgatgtcaatgcaaagaacaatgttcagcagatcttcatctccttgtaccaaagcaccatcgacaagatgagcatcttctccatgcaaggatatgaaacattgctgctctccgcctacaccggcgccgcgctgctgcaaatcaccctacttgctgaaggcatccaatatgctgatcaatgggggctggcaaggaacagcggcgacttctacagagatcagctctacaagagcatcagcaagcacatcgagcactgcgagatctggtacaagaatggcctcaacaagctgaaatcaaggccaaacatcagatggggcgccatcaccaactacagaagagagtacaccctctccgtgctgaacatcattgccaccttccctgcttttgatctccgcgtctatcctctcaaggagcagattggcctccaagcagagttcacccaagagctcttcaccatctcaccagatgttcaaaacttccagaacctccccaccatcctcaacctggaaaatgagctcatcccaaggccagatctggtgcgccatctgaagaggctctccttcttcacaagaaccaccgccggcaacctcaacaactacctggagagcatcaccaatgaaagctacagaacaaacaacaattcaacacatctggacaactatggaaacttcaacaaccaaaatcaaggaagcaacctcaccttgacaaatccagatcaagtcatctacttcgccgacatcctccatcatgcatactacaaccctccaaccatctttggaacatatggcatccgcgccatcgacttcaagattggaacaaataggcagatctcacaaacattgagatacagcagcaacaccaaccctggaggaagcatccaccagatctatgctcccttccctccaacaacacaaagcaccaacctcaccaactaccagtacatcctctcaaggatcaccatgacaaaggagagctaccccatctggggcattggcacctttgaaagcaccaagatctatggcttcaactggattcatgcttctctcaacctcaccaacagcatcagcagcatcaaccccatcggcaagaagaagatcacccagatctccgccgtcaaggccttcgacattgatggaggatcagtgattgaaggacctggccacaccggcggcaacctggtggagctgaagagaagcaactacatcaagatcagctgcaagatcatcgacagcgccgtctacaacttgaggatcagatacacctcaaacacagcaactgctgaaacaaatggcatcaggatcaccgtcatcgacaagatcaacaagagaacaagcaactatgctctgaagaacaccatcagaaatcctcaaaggccaacatcatatgacaacttcgagtacctcaacattgaaaccttctccttctatggaacagatccaaacattgagatcatgctggagaacatgagcagcggcatcatcaccatcgacaagctggagttcacgccgcag

SEQ ID NO: 113 - DNA, 1926 bp, Artificial Sequence
  synthetic nucleotide sequence encoding toxin protein
atgaacagctaccagaacaagaatgaatatgaatatgagatcctggacacctcccccaacaacagcaccatgagcaccctacatccaagatatcctctggccaaagatccatacaagccaatgaggaacaccaactacaaggaatggctggccatgtgcgccaacaacaatcaagttcctattgatcctctggacaacacctgggctggagtgatggcggcgctcttcgcctccgccgccgccattgctgggctgatgtcagctgttcctgttttctccgtggtggccaccggcacggcgctggcggcggcgctcacccccatcctcttcccaagcaatggacctgatgtttcaactcagctgatgagcaacacagaagctctgctgaagagggagctggacacatatgtccgcgcgcgcgctgattcagagttccaagctctggaagctcaaagggagttcttcaagagcgccttcgactactggaggctcaaccccaccaacagcaatgccattgccaccgtcgccgcgcgcttccacaccgtcaatggcgccttcgtcaccgccatgaggctcttcagaactgctggatatgaagctctgctgctgccagtttatgctcaagctgctcgcctccacctcctccatctacgagatggcgtcctcttcgccaatgaatggggcctagcaaaagatcctggagatcttcatgatcaagagttcaacaaatatgctgctgaatatgctgactactgcgagagcacctacaacacagagctcaacaggatcaagacagctcctggaaaaacatggcttgactacaaccagtacaggaggatcatgaccattgctgtgctggacattgctgccaagttctcaatcctcaacccgcgcctctacaggctgccgctgcaagaagagatcttgacaaggaagatctacacagatcctgtcaacttctctcctgggccaagcattgctgatgatgagaacagatacaccgtgccgccaagcatcgtccgccagctggtgggcagcaccctctacaccaatgttgcttcagctcaaaatgctggcttcatcggcaacaggaacagatatctcaacattggatttggagaaactgttgatgggccgctgattggcaacagcgtctatgaaagcagggtggctggcatcccaacaaatgaatgggtgtatgaagttggcgtcaatggcatccaaaatgattatccaaggaacatcggcctccgccgcggctcaagcaccgacttcatcaacaactatgctggaagccagtacaacctggggccgctgacaagggtgagcatccccaccaagaacaatgatcccatcaacaacatcaacttcacccaccgcctctcagacatcatccttcctggcaacagaggaagcagcttcgcctggacccatgttgatgtcaaccccaccggcaactacctctccaccaaccagatcaacttgatcccctgcaccaagatctcaaagctgccaaacagctaccagatcatcaaggggccaggcttcattggaggtgatctcatcaggttcaccagcggcagcggctacctctacaagttcaagttcaccagctctggaagctccgccaacttcaagatcaggatcagatatgctggagctggaactggacctggcctctatggaagggtgttcttccgcctaggaaactaccagagccctgacacgccatggggccaaactggcttcaccagctcaaatgccaagtacaaccagttcaaggtgctggagctctatggaacagcagagaacatcaccgacaatgatctggagatcatcgtctggacggccaacagcggcgctcaagatttcctctcaaggcagattggcatcaacccaaatgctggagacatcaacaggattcaa

SEQ ID NO: 114 - DNA, 1926 bp, Artificial Sequence
  synthetic nucleotide sequence encoding toxin protein
atgaacagctaccaaaacaagaatgaatatgaatatgagatcttggacacctctccaaacaacagcaccatgagcaccctacatccaagatatcctcttgcaaaagatccatacaagccaatgaggaacaccaactacaaggaatggctggccatgtgcgccaacaacaatcaagttcctattgatcctctggacaacacctgggctggagtgatggcggcgctcttcgcctccgccgccgccattgctggcttgatgtcagctgttcctgttttctccgtggtggccaccggcacggcgctggcggcggcgctcacccccatcctcttcccttcaaatggacctgatgtttcaactcagctgatgagcaacacagaagctctgctgaagagggagctggacacatatgtccgcgccagagctgattcagagttccaagctctggaagctcaaagagagttcttcaagagcgccttcgactactggaggctcaaccccaccaacagcaatgccattgccaccgtcgccgcgcgcttccacaccgtcaatggagccttcgtcaccgccatgaggctcttcagaactgctggatatgaagctctgctgcttcctgtttatgctcaagctgcaaggctccacctcctccatctacgagatggagttctcttcgccaatgaatggggcctagcaaaagatcctggagatcttcatgatcaagagttcaacaaatatgctgctgaatatgctgattactgtgaaagcacctacaacacagagctcaacaggatcaaaacagctcctggaaaaacatggcttgattacaaccagtacagaaggatcatgacaattgctgtgctggacattgctgcaaagttctcaatcctcaacccaaggctctacaggctgccgctgcaagaagaaatcttgacaaggaagatctacacagatcctgtcaacttctctcctggaccaagcattgctgatgatgaaaacagatacaccgtgcctccaagcatcgtccgccagctggtgggaagcaccttgtacacaaatgttgcttcagctcaaaatgctggcttcattggcaacaggaacagatatttgaacattggatttggagaaactgttgatgggccgctgattggaaacagcgtctatgaaagcagagttgctggcatcccaacaaatgaatgggtgtatgaagttggtgtcaatggcatccaaaatgattatccaaggaacattggcctccgccgcggctcaagcacagatttcatcaacaactatgctggaagccagtacaaccttgggccgctgacaagggtgagcatccccaccaagaacaatgatcccatcaacaacatcaacttcacccaccgcctctcagacatcatccttcctggaaacagaggaagcagcttcgcctggacacatgttgatgtcaacccaactggcaactacctctccaccaaccagatcaacttgatcccctgcaccaagatctcaaagctgccaaacagctaccagatcatcaaaggaccaggcttcattggaggtgatctcatcaggttcaccagcggcagcggctacctctacaagttcaagttcacctcttctggaagctccgccaacttcaagatcaggatcagatatgctggagctggaactggacctggcctctatggaagggtgttcttccgcctaggaaactaccaatctcctgacacaccatggggacaaactggcttcaccagctcaaatgcaaagtacaaccagttcaaggtgctggagctctatggaacagcagaaaacatcaccgacaatgatctggagatcatcgtctggacagcaaacagtggagctcaagatttcctctcaaggcagattggcatcaacccaaatgctggagacatcaacaggattcaa

SEQ ID NO: 115 - DNA, 1977 bp, Artificial Sequence
  synthetic nucleotide sequence encoding toxin protein
atgtcgccaaacaaccaaaatgaatatgagatcatcgacacgccaagcagcaacagcttggacaaccagttcgtcagatatcctctggccaaggagccaacacaagttcgccagaacctcaactacaaggactggctgaacagcttggatgagaacaacaaccagagcttcggcgtcacgccgcgccgcgcctcagtggtgggcgccgtcggcagcatcctcggcgccaccttgggcaccatcccatatgttggagacatcctggcgctgattgttggcatcttctggccagaaggatctgatccagaagattattcagagctcatcaatgccatcatggagcaggtggagctgctcatcgaccagaagatctcagagcaggtgagaaatgatgctctggccaccttggagagcagcggcattgctcttcaagcctacctcaatgctctggaggactggaagatcaaccccaacaatgcaagaagcacccagctggtgagggagaggttcacctttgctgaagctcaggtgaggaccaacattgcatatgtttcaaggaaggattatgagatcctgctgctgcccatctatgctcaggtggccaacatccatctactgctgctgaagcaggtgcagctctatggcaccaagctgggctacacccaaaatgacatcgacctcatctacgaggagcagaagaagttcaccgcccagtacaccaaccactgcaccaactggtacaacatcggcctcaacaacatctgggagagcattgctggaacaagctacagcggctcaagatgggatgagttcaatgatttcagaagagatctcaccttgacggtgctggacatcgtcagcaccttccccatccatgacacaaggctgtatccagagaaggtgaatggccagctgacaagggagatctacacaagaagcatcaatgtcaactacttcaaccaagtttcagcaaggaccattgaagatgctgaaaggctgctcaccaacccgccgcggctgctgccatggatcgagcagctggagttcaacaccaatgtcaacttctccgtcaactggaagttcctcaccagcacaagaagaaggttcatctacaccaacagcagcgacctgaactatgatggatatgctggatatcatctggatggaacatcaaacagcttcctctacccaagcaacaatgaaaggatctacaccatcactgctcaaagatttggagagcagaggaacatccctcaagccatcaccggcctcaccttctccatgaacactggaagaacatacagatattcaagcaacactcctgctgggccaagcatcatcactgaagattatcatcttcctggcctcaatggagaagaagttccaaacagcaacaacttcagccacttcttgaggagcatcaatggatattcaaatggcaaccagaggatcttccacagctttggatggacccatgcttctgttgattttgagaacaagatctaccccaccatcatcacccagatccccgccgtcaaggccatccaaggaacaatgccatatcctgtggtgaaggggccaggcttcactggaggagacattgcaaggctaccaaacaaccccaccctcggcctctggttcaatggcaccatggagagcttgggcagcggccatgatccggcgccgcgctacagggtgaggatcagatatgcttctcaaagcggcggcagcgccaacttcagattcatgagcagcaatggccagaacagctctcagcagaacttctccttcacctccaccatgacaactggagaaccatcaaaatatgaagatttcagattctccgtgctgccaaacatcgtcacgccgctctccttcaatgtcagctggcacctggtggccagcaatgccaaccccaacaacaatgtctacatcgacaggatcgagttcatcccagagttcttgatggcaagaagc

SEQ ID NO: 116 - DNA, 1977 bp, Artificial Sequence
  synthetic nucleotide sequence encoding toxin protein
atgtctccaaacaaccaaaatgaatatgagatcatcgacacaccaagcagcaacagcttggacaaccagttcgtcagatatcctctggccaaggagccaacacaagttcgccagaacctcaactacaaggactggctgaacagcttggatgaaaacaacaaccagagcttcggcgtcacgccgcgccgcgcctcagtggtgggcgccgtcggcagcatcctcggcgccaccttgggcaccatcccatatgttggagacatcctggcgctgattgttggcatcttctggccagaaggatctgatccagaagattattcagagctcatcaatgccatcatggagcaggtggagctgctcatcgaccagaagatctcagagcaggtgagaaatgatgctctggccaccttggagagcagcggcattgctcttcaagcatacctcaatgctctggaggactggaagatcaaccccaacaatgcaagaagcacccagctggtgagagaaaggttcacctttgctgaagctcaagtgaggacaaacattgcatatgtttcaaggaaggattatgagatcctgctgctgcccatctatgctcaagtggccaacatccatctactgctgctgaagcaggtgcagctctatggcaccaagctgggctacacccaaaatgacatcgacctcatctatgaagagcagaagaagttcactgctcagtacaccaaccactgcaccaactggtacaacattggcctcaacaacatctgggagagcattgctggaacaagctacagcggctcaagatgggatgagttcaatgatttcagaagagatctcaccttgacagtgctggacatcgtcagcaccttccccatccatgacacaaggctgtatccagagaaggtgaatggccagctgacaagggagatctacacaagaagcatcaatgtcaactacttcaaccaagtttcagcaaggaccattgaagatgctgaaaggctgctcaccaacccgccgcggctgctgccatggattgagcagctggagttcaacaccaatgtcaacttctccgtcaactggaagttcctcacctcaacaagaagaagattcatctacaccaacagcagcgacctgaactatgatggatatgctggatatcatcttgatggaacatcaaacagcttcctctacccaagcaacaatgaaaggatctacaccatcactgctcaaagatttggagaacaaaggaacattcctcaagccatcaccggcctcaccttctccatgaacactggaagaacatacagatattcaagcaacactcctgctggaccaagcatcatcactgaagattatcatcttcctggcctcaatggagaagaagttccaaacagcaacaacttcagccacttcttgagaagcatcaatggatattcaaatggcaaccaaaggatcttccacagctttggatggacacatgcttctgttgattttgagaacaagatctaccccaccatcatcacccagatccctgctgtcaaggccatccaaggaacaatgccatatcctgtggtgaaggggccaggcttcactggaggagacattgcaaggctaccaaacaaccccaccttgggcctctggttcaatggcaccatggagagcttgggcagcggccatgatccggcgccgcgctacagggtgaggatcagatatgcttctcaaagcggcggcagcgccaacttcagattcatgagcagcaatggccaaaacagctctcagcagaacttctccttcacctccaccatgacaactggagaaccatcaaaatatgaagatttcagattctccgtgctgccaaacatcgtcacgccgctctccttcaatgtcagctggcatctggtggcaagcaatgccaaccccaacaacaatgtctacatcgacaggattgagttcatcccagagttcttgatggcaagaagc

SEQ ID NO: 117 - DNA, 2406 bp, Artificial Sequence
  synthetic nucleotide sequence encoding toxin protein
atgacaaagaaccacaagaagatcctctccatgacgctggtgacaagcatgctggctggcacctacatccccaccgcctacaccgcctttgctgaaacagagcagaaggaaggaagccaagaaaatcaaactggccccatcaacaaaggaagcctgccgctggattcatatggcctcttcgagaacccctacaagggcgtcaccttcgaccagttcatgaatgccttcaacaacaacacctggaatcctctgctggttgacatcaagaacaaaggaaatgctggaagcggcaccctcaccttcttgaagggcatcatgggcaccggcctctccctgctgccgccgccggcctccctgctgggctcagtttggaatgttttcatgccaacaacagcaacaaatggaacagacatgtggaagcagctggagacatacatcgaggagaagattgatggcaagatcaaggagtaccacaagtacctaatgggagcagagttcaatggcgccatgacggccatcaaggagtaccagagggtgctccagatctacaatgacagcaagaacagcttggcaagggtggaggagcctggcacgccggtgattgaagctgtccgcgccgccgacaggaagctgaaggagttcattgccatcatccagacgccggagaacaaggcagattcagtgtaccagcagatcaccgcgcccatcttcgtccaagctgcaaatgctcatctgctgctgcaaagggacatcatcctctatggaaatgaatggggcatggacaaaggacaatgggaaggatatcaagcaaaccagaagaagctgatccaggagtacaccaactacgccatgcaagtttacaatgatggcctagagaagaggaagaaggaagcagagcagatcaacaccttggagaagtacaggaacaccgacagatggaaccacatcaacaaatatgtgagggagtacaccctctctgtgctggattttgtggagctcttcccctacactgatccaagcaagtacagcagaggcaccatccagaacaactcaaggcagatctacagcgacattggaggaaagatccagcccaaggagaggacatggcaggacatccagaagatcctggacagccaggagtacaaaggagatctgaagaggctggacatcaggagcgccgacaggattgatgccatcagagctcattattcagaaaggctctttgatgcaacaccatgggccaccaccggctggattggcaacaccaccggcggcaacctcaaggagatcccaagctatgatgatcctctcaccaaggtgacagttggatcagagatcacccccttctacctccacctggatcatgagagcggcaagacctacagcagatttggaagcaccctctccggcaagggcaccgcctccacctttgaatatcctggccagaagatctccttggttcatgccttcaacagaagcacccagcctggatttgatggcattgatgccatcgtctttggcttctcaaacaagaacctctccttgaagtaccagctggccaccaacatgatcaccaccatccctgctgagatgtacaacctgggctcaggatttggcacccaggtggagcccatccatgctcagcagaaggccatgaaaacagacaccctcaacagctacctcagatatgatgtcaagacgccaaaaacccagaagtacaagatcaagtacagggtttctgcaaatgaaagctcaaagatcaggctgctgtacaacaacaacctggtggaagaaacaagcatccctgtgatcaacaacattgctgctgacaccatcaaaggagaatatggctactacaagaccattgaagggccgacggtggagatcaaggctggagaagctgtgagcaacaggctgcaaattgaaaatggccaaggaaagttctcactggaccacatcgagctggagccgctggagagcgacgaggtggtggctcaagacaactttgatgatcgccgcctcaactggaacaacatcaagagcattgtgacagaaggcatcactggaaatgctggcaccatcggcccaaatggagacacctggacctacatcaacaaccagctggtgggaaattcaagatacaccctctccatgaaggtgaagctcaacagcaatgatgcaaatgtccgccagaaggtgacggtgttcaccgacaacaagaaccatcagcgcgtcaccaagacggtggagctaaaaggaggagctggcttccaggagatcaagctggagttcgccaccgacaagctgatgcatctggtggggctggacacccacatcggcatccaaacaagcaatggaaattctgatgtgctgtttgatgatgtcaaggtcatcggcgccaagaag

SEQ ID NO: 118 - DNA, 2406 bp, Artificial Sequence
  synthetic nucleotide sequence encoding toxin protein
atgacaaagaaccacaagaagatcctctccatgaccttggtgacaagcatgctggctggaacatacatccccaccgcctacaccgcctttgctgaaacagagcagaaggaaggaagccaagaaaatcaaactggccccatcaacaaaggaagcctgccgctggattcatatggcctcttcgagaacccctacaagggcgtcaccttcgaccagttcatgaatgccttcaacaacaacacctggaatcctctgctggttgacatcaagaacaaaggaaatgctggaagcggcaccctcaccttcttgaagggcatcatgggcaccggcctctccttgctgccgccgccggcctccttgctgggctcagtttggaatgttttcatgccaacaacagcaacaaatggaacagacatgtggaagcagctggaaacatacatcgaggagaagattgatggaaagatcaaggagtaccacaagtacctaatgggagcagagttcaatggagcaatgacggccatcaaggagtaccaaagggtgctccagatctacaatgacagcaagaacagcttggcaagggtggaggagcctggcacgccggtgattgaagctgtccgcgccgccgacaggaagctgaaggagttcattgccatcatccagacgccggagaacaaggcagattcagtgtaccagcagatcaccgcgcccatctttgttcaagctgcaaatgctcatctgctgctgcaaagagacatcatcctctatggaaatgaatggggcatggacaaaggacaatgggaaggatatcaagcaaaccagaagaagctgatccaggagtacaccaactatgccatgcaagtttacaatgatggcctagagaagaggaagaaggaagcagagcagatcaacaccttggagaagtacaggaacaccgacagatggaaccacatcaacaaatatgtgagggagtacaccctctctgtgctggattttgtggagctcttcccctacactgatccaagcaagtacagcagaggaaccatccagaacaattcaaggcagatctacagcgacattggaggaaagatccagccaaaggagaggacatggcaggacatccagaagatcctggacagccaagaatacaaaggagatctgaagaggctggacatcaggagcgccgacaggattgatgccatcagagctcattattcagaaaggctctttgatgcaacaccatgggccaccactggatggattggaaacaccaccggcggcaacctcaaggagattccaagctatgatgatcctctcaccaaggtgacagttggatcagagatcacccccttctacctccatctggatcatgaaagcggcaagacatacagcagatttggaagcaccctctccggcaagggcaccgcctccacctttgaatatcctggccagaagatctccttggttcatgccttcaacagaagcacccagcctggatttgatggcattgatgccatcgtctttggcttctcaaacaagaacctctccttgaagtaccagctggccaccaacatgatcaccaccatccctgctgagatgtacaaccttggatcaggatttggaacccaggtggagcccatccatgctcagcagaaggccatgaaaacagacaccttgaacagctacttgagatatgatgtcaagacaccaaaaacacagaagtacaagatcaagtacagagtttctgcaaatgaaagctcaaagatcaggctgctgtacaacaacaacctggtggaagaaacaagcatccctgtgatcaacaacattgctgctgacaccatcaaaggagaatatggctactacaagaccattgaagggccaacagtggagatcaaggctggagaagctgtgagcaacaggctgcaaattgaaaatggacaaggaaagttctcattggaccacatcgagctggagccgctggagagcgacgaggtggtggctcaagacaactttgatgatcgccgcctcaactggaacaacatcaagagcattgtgacagaaggcatcactggaaatgctggcaccattggaccaaatggagacacctggacctacatcaacaaccagctggtgggaaattcaagatacaccctctccatgaaggtgaagctcaacagcaatgatgcaaatgttcgccagaaggtgacagtgttcaccgacaacaagaaccatcaaagggtcaccaagacagtggagctaaaaggaggagctggcttccaggagatcaagctggagttcgccaccgacaagctgatgcatctggtggggctggacacccacattggcatccaaacaagcaatggaaattctgatgttctctttgatgatgtcaaggtcatcggcgccaagaag

SEQ ID NO: 119 - DNA, 2190 bp, Artificial Sequence
  synthetic nucleotide sequence encoding toxin protein
atgaatgccttcaacaacaacacctggaacccgctgctggtggacatcaagaacaaaggaaatgctggaagcggcaccctcaccttcttgaagggcatcatgggcaccggcctctccctgctgccgccgccggcctccctgctgggctcagtttggaatgttttcatgccaacaacagcaactaatggaacagacatgtggaagcagctggaaacctacatcgaggagaagattgatggcaagatcaaggagtaccacaagtacctaatgggagcagagttcaatggcgccatgacggccatcaaggagtaccagagggtgctccagatctacaatgacagcaagaacagcttggcaagggtggaggagcctggaactcctgtcattgaagctgttcgagctgctgacaggaagctgaaggagttcattgccatcatccagacgccggagaacaaggcagattcagtgtaccagcagatcaccgcgcccatcttcgtccaagctgcaaatgctcatctgctgctgcaaagggacatcatcctctatggaaatgaatggggcatggacaaaggacaatgggaaggatatcaagcaaaccagaagaagctgatccaggagtacaccaactacgccatgcaagtttacaatgatggcctagagaagaggaagaaggaagcagagcagatcaacaccttggagaagtacaggaacaccgacagatggaaccacatcaacaaatatgtcagggagtacaccttgagcgtgctggattttgtggagctcttcccctacactgatccatcaaagtacagcagaggcaccatccagaacaacagcaggcagatctacagcgacattggaggaaagatccagcccaaggagaggacatggcaggacatccagaagatcctggacagccaggagtacaaaggagatctgaagaggctggacatcaggagcgccgacaggattgatgccatcagagctcattattcagaaaggctctttgatgcaacaccatgggccaccaccggctggattggcaacaccactggaggaaacctgaaggagatcccaagctatgatgatcctctcaccaaggtcaccgtcggcagcgagatcacccccttctacctccacctggatcatgagagcggcaagacatattcaagatttggaagcaccttgagtggaaaaggcaccgcctccacctttgaatatcctggccagaagatctccttggttcatgccttcaacagaagcacccagcctggatttgatggcattgatgccatcgtctttggcttcagcaacaagaacctctccttgaagtaccagctggccaccaacatgatcaccaccatccctgctgagatgtacaacctgggctcaggatttggcacccaggtggagcccatccatgctcagcagaaggccatgaaaacagacaccctcaacagctacctcagatatgatgtcaagacgccaaaaacccagaagtacaagatcaagtacagggtttcagcaaatgaaagcagcaagatcaggctgctgtacaacaacaacctggtggaagaaacaagcatccctgtgatcaacaacattgctgctgacaccatcaaaggagaatatggctactacaagaccattgaagggccgacggtggagatcaaggctggagaagctgtgagcaacaggctgcaaattgaaaatggccaaggaaagttctcactggaccacatcgagctggagccgctggagagcgacgaggtggtggctcaagacaactttgatgatcgccgcctcaactggaacaacatcaagagcattgtgacagaaggcatcactggaaatgctggcaccatcggcccaaatggagacacctggacctacatcaacaaccagctggtgggcaacagcagatacaccctctcaatgaaggtgaagctcaacagcaatgatgcaaatgtccgccagaaggtgacggtgttcaccgacaacaagaaccatcagcgcgtcaccaagacggtggagctaaaaggaggagctggcttccaggagatcaagctggagttcgccaccgacaagctgatgcatctggtggggctggacacccacatcggcatccaaacaagcaatggaaattctgatgtgctgtttgatgatgtcaaggtcatcggcgccaagaag

SEQ ID NO: 120 - DNA, 2190 bp, Artificial Sequence
  synthetic nucleotide sequence encoding toxin protein
atgaatgccttcaacaacaacacctggaacccgctgctggtggacatcaagaacaaaggaaatgctggaagcggcaccctcaccttcttgaagggcatcatgggcaccggcctctccttgctgccgccgccggcctccttgctgggctcagtttggaatgttttcatgccaacaacagcaactaatggaacagacatgtggaagcagctggaaacctacatcgaggagaagattgatggcaagatcaaggagtaccacaagtacctaatgggagcagagttcaatggcgccatgacggccatcaaggagtaccaaagggtgctccagatctacaatgacagcaagaacagcttggcaagggtggaggagcctggaactcctgtcattgaagctgttcgagctgctgacaggaagctgaaggagttcattgccatcatccagacgccggagaacaaggcagattcagtgtaccagcagatcaccgcgcccatctttgttcaagctgcaaatgctcatctgctgctgcaaagagacatcatcctctatggaaatgaatggggcatggacaaaggacaatgggaaggatatcaagcaaaccagaagaagctgatccaggagtacaccaactatgccatgcaagtttacaatgatggcctagagaagaggaagaaggaagcagagcagatcaacaccttggagaagtacaggaacaccgacagatggaaccacatcaacaaatatgtcagggagtacaccttgagcgtgctggattttgtggagctcttcccctacactgatccatcaaagtacagcagaggaaccatccagaacaacagcaggcagatctacagcgacattggaggaaagatccagccaaaggagaggacatggcaggacatccagaagatcctggacagccaagaatacaaaggagatctgaagaggctggacatcaggagcgccgacaggattgatgccatcagagctcattattcagaaaggctctttgatgcaacaccatgggccaccaccggctggattggaaacaccactggaggaaatttgaaggagatcccaagctatgatgatcctctcaccaaggtcaccgtcggcagcgagatcacccccttctacctccatctggatcatgaaagcggcaagacatattcaagatttggaagcaccttgagtggaaaaggaacagcctccacctttgaatatcctggccagaagatctccttggttcatgccttcaacagaagcacccagcctggatttgatggcattgatgccatcgtctttggcttcagcaacaagaacctctccttgaagtaccagctggccaccaacatgatcaccaccatccctgctgagatgtacaaccttggatcaggatttggaacccaggtggagcccatccatgctcagcagaaggccatgaaaacagacaccttgaacagctacttgagatatgatgtcaagacaccaaaaacacagaagtacaagatcaagtacagagtttcagcaaatgaaagcagcaagatcaggctgctgtacaacaacaacctggtggaagaaacaagcatccctgtgatcaacaacattgctgctgacaccatcaaaggagaatatggctactacaagaccattgaagggccgacggtggagatcaaggctggagaagctgtgagcaacaggctgcaaattgaaaatggccaaggaaagttctcattggaccacatcgagctggagccgctggagagcgacgaggtggtggctcaagacaactttgatgatcgccgcctcaactggaacaacatcaagagcattgtgacagaaggcatcactggaaatgctggcaccattggaccaaatggagacacctggacctacatcaacaaccagctggtgggcaacagcagatacaccctctcaatgaaggtgaagctcaacagcaatgatgcaaatgtccgccagaaggtgacagtgttcaccgacaacaagaaccatcaaagggtcaccaagacggtggagctaaaaggaggagctggcttccaggagatcaagctggagttcgccaccgacaagctgatgcatctggtggggctggacacccacattggcatccaaacaagcaatggaaattctgatgttctctttgatgatgtcaaggtcatcggcgccaagaag

SEQ ID NO: 121 - DNA, 2679 bp, Artificial Sequence
  synthetic nucleotide sequence encoding toxin protein
atggagagaggaaagatcatgaacctcaagagcgtgttcaagtgcttcaccatcaccgccatcctggcgcagctcaccgtctaccccgccatcagctatgctgaaagcaacaatgagaagaacatggacatgaaaaccaccattggagagaagaagggcgtcaccggcctggtgggctactacttcaaggatgttcagttcaccaacctctccttgatctcatttggagagcagagcaagctggccaaccaaacaaagatgaagaagcacaaccaaacatttgagagcgcgcgctggatgggaaggatcaaggccagccaaactggagaatacaccttctccaccgcctcagatcaaaacatcatcctccaggtgaatggagaaaccatcatcaaccaaggaaagatggagaagccgctgaagctggagaagaacaaggcatatgagctgaagattgaatatcaaaacatcaaggacacctctccagatctccagctcttctggagcattgaaggaaaggagaaggagaagattccagaagaaaacctcctctcccccaacctctcagaaagggacaagctctccaaggacaacaaggacaccctcttccttccagatttcaacctcttcaacaacagcattgtgaaggatcttccagattcagatcgagatggcatccctgatgaatgggaggagaatggctacagggtgcaaggatatgatgagattgtgaaatgggatgatgttgatctggccaagggctacaagaaatatgtcagcaacccatattcaccaaaaacagcaaatgatccatacacagattttgagaaggtggctggcttcatgcctgctggcaccaaggatgaagcaagagatcctctggtagctgcctaccccgccatcggcgtcggcatggagaagttcatcttctcaaaaaatgacaatgtcactgatggccagagcggcagcgtcagcaagacaacaagcagcagcaccagcaacagccacaccgtcggcgccggcaccaagctggagctgagcaccaaccccttcgcgctggcaaaatgggagatggcgctcaactacagctggacaggaaactggacaacaggatttgaagaaacaaacagccaaagctggtcaagggagatccagatgaacaccgccgagcgcgcctacctcaatgcaaatgtcagatactacaacactggaacagctcccatctacaagattgctccaacaacaagcctggtgctccgtgatccaaaagatcctctcaatgccaacaagaccaccaccatcaagacggtgaaggccaccaatggcctggtgggagagagcttggggccagaaggaacttatccttcacaaggcctcgccggcctggcgctggacaggctggaggatggaacaaggatctccatcaatgctgagcagctggacagcatccagaacaacagcaagaagctctcactggaaactcctcaagttggaggacaatatgggctgctgagagatggagggctggtgatcaatgacttccaaacatgggcgccaattcagagcggcatcgacagcaccagcggcgcgctggtgctggacaccggcaacatcaatggaaatctagcaaggaaggtcaccgccaagaatgaaaatgatccaaatgacaggacgccggtgatcaccatcagagaagctgtgaagaaggccttcaatgccaaggagaaggatggccgcctctactacacagatccaaaaggaaaggagattgatctggatgaaagcctcatcaccttcatcttcgacaacaacacagagcaggagatcaagaggcagctagagaacatgcaagacaagaaggtgtacaatgcaagatggaagagagggatgaacatcaccatcaggacgcccatcgtcagctatgattttgagaacaccaacaatgttggatggtatggcgccaccgtggtgaatggaggctacaccggcaacaagcatgctcaaattgctccaaatggaaatggatatgcaaaaacagatctggagctaaagcctcacaccccctacaccgtccgcgcctatgtcaagccttctgctgccaaccacaatgtggtgttctacaccaccaatgatggaaaaggacaagaatatccaacaaccctcaatggagatcaatggcatgtcatcgagtacaccttcaacactggagctcatccagagaacttcaagaagctggggctgaagaatgaaggaaatgccatcctaaatgtggacaatgtttttgttcaagaatggggcgccgtgctgggagaagatgccaccaacctcatcaacaatggagatttctcagaaggcctcaactggtgggaggaccacaaaggagaaattgaagatggctacttcaaaggaagctacctcaagagcaaccagttcaacatcaagcagaacaagcagtaccagctgaccttcgacagcaagctggacattggaagcaaccctggcaagatctatgtcagcttcctggattcaggcatcagcaacattgagatcaacctggacaacagctggaaccaccacagctacaagatcaccttccccaccgacaagaatgtcaacctcgccttcatctccctctcccccaagttcaacctggacaacatcaagtttgaggaggtgaag

SEQ ID NO: 122 - DNA, 2679 bp, Artificial Sequence
  synthetic nucleotide sequence encoding toxin protein
atggagagaggaaagatcatgaacctcaagagcgtgttcaagtgcttcaccatcaccgccatcctggcgcagctcaccgtctaccccgccatcagctatgctgaaagcaacaatgagaagaacatggacatgaaaacaaccattggagagaagaagggcgtcaccggcctggtgggctactacttcaaggatgttcagttcaccaacctctccttgatctcatttggagagcagagcaagctggccaaccaaacaaagatgaagaagcacaaccaaacatttgagagcgcgcgctggatgggaaggatcaaggccagccaaactggagaatacaccttctccaccgcctcagatcaaaacatcatcctccaggtgaatggagaaaccatcatcaaccaaggaaagatggagaagccgctgaagctggagaagaacaaggcatatgagctgaagattgaatatcaaaacatcaaggacacctctccagatctccagctcttctggagcattgaaggaaaggagaaggagaagattccagaagaaaacctcctctcccccaacctctcagaaagggacaagctctccaaggacaacaaggacaccctcttccttccagatttcaacctcttcaacaacagcattgtgaaggatcttccagattcagatcgagatggcatccctgatgaatgggaagaaaatggctacagggtgcaaggatatgatgaaattgtgaaatgggatgatgttgatctggccaagggctacaagaaatatgtcagcaacccatattcaccaaaaacagcaaatgatccatacacagattttgagaaggtggctggcttcatgcctgctggcaccaaggatgaagcaagagatcctctggtagctgcctaccccgccatcggcgtcggcatggagaagttcatcttctcaaaaaatgacaatgtcactgatggccagagcggcagcgtcagcaagacaacaagcagcagcaccagcaacagccacaccgtcggcgccggcaccaagctggagctgagcaccaaccccttcgcgctggcaaaatgggagatggcgctcaactacagctggacaggaaactggacaacaggatttgaagaaacaaacagccaaagctggtcaagggagatccagatgaacaccgccgagcgcgcctacctcaatgcaaatgtcagatactacaacactggaacagctcccatctacaagattgctccaacaacaagcctggtgctccgtgatccaaaagatcctctcaatgccaacaagaccaccaccatcaagacggtgaaggccaccaatggcctggtgggagagagcttggggccagaaggaacttatccttcacaaggcctcgccggcctggcgctggacaggctggaagatggaacaaggatctccatcaatgctgagcagctggacagcatccagaacaacagcaagaagctctcactggaaactcctcaagttggaggacaatatgggctgctgagagatggagggctggtgatcaatgatttccaaacatgggcgccaattcagagcggcatcgacagcaccagcggcgcgctggtgctggacaccggcaacatcaatggaaatctagcaaggaaggtcaccgccaagaatgaaaatgatccaaatgacaggacgccggtgatcaccatcagagaagctgtgaagaaggccttcaatgccaaggagaaggatggccgcctctactacacagatccaaaaggaaaggagattgatctggatgaaagcctcatcaccttcatcttcgacaacaacacagagcaggagatcaagaggcagctagagaacatgcaagacaagaaggtgtacaatgcaagatggaagagagggatgaacatcaccatcaggacgcccatcgtcagctatgattttgagaacaccaacaatgttggatggtatggcgccaccgtggtgaatggaggctacaccggcaacaagcatgctcaaattgctccaaatggaaatggatatgcaaaaacagatctggagctaaagcctcacaccccctacaccgtccgcgcctatgtcaagccttctgctgccaaccacaatgtggtgttctacaccaccaatgatggaaaaggacaagaatatccaacaaccctcaatggagatcaatggcatgtcatcgagtacaccttcaacactggagctcatccagagaacttcaagaagctggggctgaagaatgaaggaaatgccatcctaaatgtggacaatgtttttgttcaagaatggggcgccgtgctgggagaagatgccaccaacctcatcaacaatggagatttctcagaaggcctcaactggtgggaagatcacaaaggagaaattgaagatggctacttcaaaggaagctacctcaagagcaaccagttcaacatcaagcagaacaagcagtaccagctgaccttcgacagcaagctggacattggaagcaaccctggaaagatctatgtcagcttcctggattcaggcatcagcaacattgagatcaacctggacaacagctggaaccaccacagctacaagatcaccttccccaccgacaagaatgtcaacctcgccttcatctccctctcccccaagttcaacctggacaacatcaagtttgaggaggtgaag

SEQ ID NO: 123 - DNA, 1914 bp, Artificial Sequence
  synthetic nucleotide sequence encoding toxin protein
atggatgtcaacaagttctatggaagcagaaatgtcaacaggatgctgaacaaccccttcaacaacagcacccagaaggagctgctgccggtggtcactcaaaatccatgtgtggacaaccccttcgtcaacaagatcaaccaaacagagatgctcaccaacacctcaattgctctcaacaccgtcgccggcgtcaccggcgccgtgcttggtagccttggagttcctggagcttcattgatcaccagcttctaccagaaggtgctggggctgctctggccaacaaacagcagagctgagatctgggacagcttcatctccgtggtggaggacctcatcaagaaggaggtggagaactatgcaagggagaaggccatcaccgagctggaaggcctcggcgacaacatgaaggactacaaatcaaagctccagcaatggctggacacgccaaatgatgacaccaagaggagcttgaagcactacatggaatcattggacatggacttcaaggagcacatgccgcagttcagaatcaaaggatatgaggtgcagctgctgccggtgtttgctcatgctgccaacctccacctgagcctcttcagagacatggtgctgtatggaccagatcttggcttcaccccagaagatctttcagaggactaccagcagctccagcagaggatcatcgactacaccaaccactgcaacctctacttcgagcaaggcctctcctccttgaagaagagcagctatgaagaatgggtgatctacaacaggttcagaagggagatgaccttgatggtgctggacatcattgctcagttcccctactatgatgtcaagaagtaccccaagcctgtttcaacccagctgacaagggaggtgtacacagatcctctcatcaccagcttcttccagcctggccaaggaccaaacttctccttcatggaatcaaatgccatcagaaatcctcatctggtgacatatcttgacagcctctacatctacaccgccaagttccgcgcctacagccaggagatccagccagatctctacttctggacggcgcacaagggcaagtacaagctgagcgcctcaacagatgttcatgacaccgcgctctatggaagcacctctggaagcatctcagagaagaactacagcttcaatggcaacaacatctaccaaactcttgctgctccttctgctgtgttcaccaccagcaagcagtactatggcattgagcaggtggagttctatggagacaagggcaagatccactactatggagacaggaaatatcctctgagcgtggacagcgccaaccagctgccgccagatgaagaacccatctcagagaactatgatcacatcctcacccatgcttctgctgtcaatgtgctggatggaggaacagttcccatcttcgcctggacccaccgctccgccgactactacaacaccatctacagcgacaagatcacccagatccctgctgtgaagatcaacaagctggagaacccttcaacagtggtgaaggggccaggcttcactggaggtgatctggtgaagagaggaagcaccggcatcctcggctacctcaatgtcaccgtcaactcgccgctctcacaaagatatgctgtgaagatcagatatgcttccaccatctctggagatttccatgttcagattgatggcgtcgccaccttggaaggccactgcgagagcaccatcaacagcggcgacgagctctcatttgagagcttcagctacaaggagttctccaccaccgtgcagttcaccggcaacaagccgcgcctccgcctgagcttggacaaggtggctggcaccggcgtgttctacttcgacaagatcgagttcatccctgttgatgtcaactatgatgaaagagtt

SEQ ID NO: 124 - DNA, 1914 bp, Artificial Sequence
  synthetic nucleotide sequence encoding toxin protein
atggatgtcaacaagttctatggaagcagaaatgtcaacaggatgctgaacaaccccttcaacaacagcacccagaaggagctgctgccggtggtcactcaaaatccatgtgtggacaaccccttcgtcaacaagatcaaccaaacagagatgctcaccaacacatcaattgctctcaacaccgtcgccggcgtcaccggcgccgtgcttggtagccttggagttcctggagcttcattgatcaccagcttctaccagaaggtgctggggctgctctggccaacaaacagcagagctgagatctgggacagcttcatctccgtggtggaagatctcatcaagaaggaggtggagaactatgcaagggagaaggccatcacagagctggaaggcctcggcgacaacatgaaggactacaaatcaaagctgcaacaatggctggacacaccaaatgatgacaccaagaggagcttgaagcactacatggaatcattggacatggacttcaaggagcacatgcctcagttcagaatcaaaggatatgaggtgcagctgctgccagtttttgctcatgctgcaaacctccatctgagcttgttcagagacatggtgctgtatggaccagatcttggcttcactccagaagatctttcagaagattaccagcagctccagcaaaggatcatcgactacaccaaccactgcaacctctacttcgagcaaggcctctcctccttgaagaagagcagctatgaagaatgggtgatctacaacaggttcagaagagagatgacattgatggtgctggacatcattgctcagttcccctactatgatgtcaagaagtaccccaagcctgtttcaacacagctgacaagggaggtgtacacagatcctctcatcaccagcttcttccagcctggacaaggaccaaacttctccttcatggaatcaaatgccatcagaaatcctcatctggtgacatatcttgattctctgtacatctacaccgccaagttccgcgcctacagccaagagatccagccagatctctacttctggacggcgcacaagggcaagtacaagctgagcgcctcaacagatgttcatgacactgctctctatggaagcacctctggaagcatctcagagaagaactacagcttcaatggaaacaacatctaccaaactcttgctgctccttctgctgttttcaccaccagcaagcagtactatggcattgagcaggtggagttctatggagacaaaggaaagatccactactatggagacagaaaatatcctctgagcgtggacagcgccaaccagcttcctccagatgaagaacccatctcagaaaattatgatcacatcctcacccatgcttctgctgtcaatgtgctggatggaggaacagttcccatcttcgcctggacccaccgctccgccgactactacaacaccatctacagcgacaagatcacccagattcctgctgtgaagatcaacaagctggagaatccatcaacagtggtgaaaggacctggcttcactggaggtgatctggtgaagagaggaagcactggcatccttggctacctcaatgtcaccgtcaactcgccgctctcacaaagatatgctgtgaagatcagatatgcttccaccatctctggagatttccatgttcaaattgatggagtggccaccttggaaggccactgtgaaagcaccatcaacagcggcgacgagctctcatttgagagcttcagctacaaggagttctccaccaccgtgcagttcaccggcaacaagccgcgcctccgcctgagcttggacaaggtggctggcaccggcgtgttctacttcgacaagattgagttcatccctgttgatgtcaactatgatgaaagagtt

SEQ ID NO: 125 - DNA, 987 bp, Artificial Sequence
  synthetic nucleotide sequence encoding toxin protein
atggtgagagattatccagattttgatggcatgctgaggaaggcagcaaggaaatgggcagaagcaaacaggctcaccttccaggacatcagctatgctgatcctctcaccaacagcgacaccatctccctcaatgtcaagttcaaggacattggctgcccagaagaatgtgtggagctggagaggatctcagtgagccaagccttcaccaacaacaccggccagcagcagaaggaaaccttcaagacaacaacatatgtggaggatgagtacacctgggagaatgattatcattttgttcttcctggccagaacttcctcatcatgccaaggctgccaagatcagctcaccgcgacatcaaccctggcttcctggtgaacttctttggagaaaaccagcagttccacaccaagatgagggagctacggccaattgaaggagaggtgttcctggagccaagcagcagcgccaccatccagctccaggtggagaagcagtacatctctcagccatatgagatcgagctctccatcctcggcagcatcatcgtcattgcaagagatcgccagaacagaagctcagagaactatgtccgcctcactgatctgatgccgctgctctgcccctgcaagaacttcagctgccgaggaagagctctggtgtttgtggagcaaggaaccttcaagggcgtcctctcaagggccatcagagcttatgtcacccaaaccctccacaaggatggcaagatgctggaatatgagatcccgctgaatgcttctccagaaagagaaagggagttctcgccgcagccgctggcggcgcgctgcatctcagatgaagaaagcaatgtcaacccctccatcctcagcagcaggccaagcaaccccaccgcctacagccagcagccaatgaccaccaacagcaccagctgcggctgctccagctgcatgtcagagaagagcaacagcaacctctacatcaaccag

SEQ ID NO: 126 - DNA, 987 bp, Artificial Sequence
  synthetic nucleotide sequence encoding toxin protein
atggtgagagattatccagattttgatggcatgctgaggaaggcagcaagaaaatgggcagaagcaaacaggctcaccttccaagacatcagctatgctgatcctctcaccaacagcgacaccatctccttgaatgtcaagttcaaggacattggctgcccagaagaatgtgtggagctggagaggatctcagtgagccaagccttcaccaacaacaccggccagcagcagaaggaaaccttcaaaacaacaacatatgttgaagatgaatacacctgggaaaatgattatcattttgttcttcctggacaaaacttcctcatcatgccaaggctgccaagatcagctcatcgagacatcaaccctggcttcttggtgaacttctttggagaaaaccagcagttccacaccaagatgagggagctacggccaattgaaggagaagttttcttggagccaagcagcagcgccaccatccagctgcaagtggagaagcagtacatctctcaaccatatgagattgagctctccatccttggaagcatcatcgtcattgcaagagatcgccaaaacagaagctcagaaaattatgttcgcctcactgatctgatgccgctgctctgcccctgcaagaacttcagctgccgaggaagagctctggtgtttgtggagcaaggaaccttcaagggcgtcctctcaagagccatcagagcttatgtcacccaaaccctccacaaggatggaaagatgctggaatatgagattcctctgaatgcttctccagaaagagaaagagagttctcgccgcagccgctggcggcgcgctgcatctcagatgaagaaagcaatgtcaacccaagcatcctcagcagcaggccaagcaaccccaccgcctacagccagcagccaatgacaacaaacagcaccagctgcggctgctcaagctgcatgtcagagaagagcaacagcaacctctacatcaaccaa

SEQ ID NO: 127 - DNA, 1056 bp, Artificial Sequence
  synthetic nucleotide sequence encoding toxin protein
atgaagaagtactgcaaccccaacaaggtgaacccaaatgaggtgaacccaacagagttcatcctcttcgacctggactactacctggaccacaacatggcaaatgtggagagctaccccatcgagctctactacatgctggatgactacaagccatcaggaggatggcacttcgaccggccatatctgccgacgccaacaagctaccaagttccaaatgcttgtgtttcagtgaatggcctcaactactgcaccttcaagccatatcaagaaaatgcttggtatgtggacaccgccaacttgattgctgaaggaacagacacatatgaggacatcgagagcatggcgctggaaactcccatcattgctgatcgccatgagtaccacaacaacagcagcctccagcagagctatgtttctccagcatattcagaaactgtcaccaccaccaccaccaacaccaccacccatggctgcaaggtgaaccccaagatcagctacagcaggaagagcaagtacaaggtgggcatcaaggacattgaaaatggcttcaacctggagctgggagcagagtacaacttcagcaacaccaacaccaacaccgccaccaccacaagaactgtcaccttcccttcattcaccacccaagttcctccctacaccaccgccatcgtcaccatcctgctgaacaaaggaacatatgccaactacaatgttcctgttcaaacaaacctctttggaagatttgacagggtggacatcagggacacgccgccctccgtcggcgccaccttcgacctctaccccttcgtggagctggtgcaaacctgctgcgacgccacctgctcagattgtgtcaccgacatggtgcaagctcttcctgacaacctcaccgtgaggttcaatggaactggcagcttcattgctgatgttgcaagcaacaacttcgtcgtcaacacagaatttgtggacaatgccaccggcgccaccgtcagcaagaggacagaatatgttcctgccatctatgggccggccaccacctccgtcagcaccagc

SEQ ID NO: 128 - DNA, 1056 bp, Artificial Sequence
  synthetic nucleotide sequence encoding toxin protein
atgaagaagtactgcaaccccaacaaggtgaatccaaatgaggtgaatccaacagagttcatcctctttgatctggactactacctggatcacaacatggcaaatgtggagagctaccccatcgagctctactacatgctggatgactacaagccatcaggaggatggcacttcgacaggccatatctgccaacaccaacaagctaccaagttccaaatgcttgtgtttcagtgaatggcctcaactactgcaccttcaagccatatcaagaaaatgcttggtatgtggacaccgccaacttgattgctgaaggaacagatacatatgaggacattgaaagcatggcgctggaaactcccatcattgctgatcgccatgaataccacaacaacagcagcttgcagcaaagctatgtttctccagcatattcagaaactgtcaccaccaccaccaccaacaccaccacccatggctgcaaggtgaaccccaagatcagctacagcaggaagagcaagtacaaggtgggcatcaaggacattgaaaatggcttcaacctggagcttggagcagaatacaacttcagcaacaccaacaccaacaccgccacaacaacaagaactgtcaccttcccttcattcaccacccaagttcctccatacaccaccgccatcgtcaccatcctgctgaacaaaggaacatatgcaaactacaatgttcctgttcaaacaaacctctttggaagatttgacagggtggacatcagggacacgccgccctccgtcggcgccaccttcgacctctaccccttcgtggagctggtgcaaacatgctgtgatgccacctgctcagattgtgtcaccgacatggtgcaagctcttcctgacaacctcaccgtgaggttcaatggaactggcagcttcattgctgatgttgcaagcaacaacttcgtcgtcaacacagaatttgtggacaatgccaccggcgccaccgtcagcaagagaacagaatatgttcctgccatctatgggccggccaccacctccgtcagcaccagc

SEQ ID NO: 129 - DNA, 2559 bp, Artificial Sequence
  synthetic nucleotide sequence encoding toxin protein
atggccaacctcaatgagatctacccctccttctacaatgtgctggcatatcctccagcaaacttcgacaatgatccaagcagctgggaggtgtacaagaagaaccagaaggagctcaatgacaaatggaatgattatgacagcaacttccttccagatccagtgatggacaccatcaacagcttggtgaacatctacaaggacactcctggatcatatgttcagtttgctcagatggccatcagagatgccttcctggtgctgccaggaggacaaacagcagcatgggccatcaacaaggtgctgggcctcatcttcccttctcatgagaagagcctcttcgaccagatcatggaagctgtcaaggagatggtggaagcagatttcaagaacctggcgctgaaccagatccaagctgtcattgaaggcttcagatcacctcttggccacttctccgacagcattcagctggcgctggggaagccaaccttccccaccagcttccctccttctggagtgagcatcatcatgccaagcaacagcacagattgcagcaaggattctgattgcaactgctccaacagcgcgccaaacagcgacagcaatgctgctccctgcacgccgtgcagctgccgcatctcaaatgtctaccaggagttcaccaacacaagggacatcattgaagctgctcttcctgggctgctgaaccccctcaacaacatcctcaatggcacctccatggccgactacatgaagatggggctgccgctctatgtcattgctgcttccttgaaccttgctctacacaagaactacattgcttttgctcaaaaatgggattatgatcctgctggaacaaatgtcatcgtcaggaacctccgcgacaggatcatcgagtacagcaacaatgtctacaccatcttcaccaagtacctgccgccgctcaccgacaacagcaagagcggcctcaatgcctacatcagatacacaaggaacatcaccttaaatgctctggacaccgtcgccggctggccaatgatgaacaccaatgactaccccatcggcaccaatgtcaagttcacaaggatcttgttcaatgacatcgtcggcccggtggagtactacaagggctcgccaacaagagatgacagcagcctccacttcaacctctatgatctcaacaagaagcagctaccaaacaacagcatctccgactacttctacaatggcatgcagctctcctccttgaagttccaaaccttctaccacagctacaaggaatgctatcctcttgggctggatgcaagctatgatgccaacaatggagttcccatcaggcagctgcaaagcaacagcagaggaacatcatggagcaacaacctctttgaagattggccgctgctctcctccctcaacatggcctccacccaaggaggctatgatgtggccaacatcatagcagaaggagacaccatcagcagcggctgtgatggagatccaaggaccatcagccacaacccagcatatgtcaaccagaggattcaagccatctaccccgtgcagccaacaaatccatcaagctatcctggatatggaagcaccgacaagatcggcctcatcaccaccttgatcccaaatgacaccacctacctcatcgacctcaacccagaggagatctccaccttccctgctgagctctcatatgacaccaatggcaccaccctcatcgagtacatgaatggcgccgccgccctccagctgatgccaaatcaatatgccaagtacatcatcagcaactatgacatggacacaagcagcagccaaggagttcaagtccgcgtccgcgccgccaccacccaagatggaggaagcctctccatcaccgtcaaccagcaaacacaaaccttgaagctctcaaacaccaccaacaccgactacacccagatcgtcatcaagggcaagcaaggatattatggcctcttccctccaactgacagccagaaccccaagcagaggacaagcaacatcttccagctgccaaattcatacaacaacaccgccatcatccagaacaactctcaagttcccatcatcctggacaggattgaatttgttcctgtgagcgcgccggcgccagatccttctccagattctggcaagcccatccacaagagcgtgccaaaaactgtcacccagctctccaccaccaaggagatctggagcagcacctcagaatatgccaccaccatcagcttcactggaaatgtctacaatgatgcttccatcaccttccagctgctctcctccggccaggtggtgaaggagttccccttcactggaaatggcgtcgccagcaagcctggcttccatggaagctcaccaagctgctatgacacgccatatcccttctcccagccagatctctccgtccccaagtacaacaagctccaggtggtgatgaagagtgatggctacagcaagccatgtgatcttggagacagcttccccaacacctttgatgctgagatcgacatcaagttcaacctctccgacaccgcc

SEQ ID NO: 130 - DNA, 2559 bp, Artificial Sequence
  synthetic nucleotide sequence encoding toxin protein
atggccaacctcaatgagatctacccttccttctacaatgtgctggcatatcctccagcaaacttcgacaatgatccaagcagctgggaggtgtacaagaagaaccagaaggagctcaatgacaaatggaatgattatgacagcaacttccttccagatccagtgatggacaccatcaacagcttggtgaacatctacaaggacactcctggatcatatgttcaatttgctcagatggccatcagagatgccttcttggtgctgccaggaggacaaacagcagcatgggccatcaacaaggtgctgggcctcatcttcccttctcatgagaagagcttgttcgaccagatcatggaagctgtcaaggagatggtggaagcagatttcaagaacctggcgctgaaccagatccaagctgtcattgaaggcttcagatcacctcttggccacttctctgacagcattcagctggcgctggggaagccaaccttccccaccagcttccctccttctggagtgagcatcatcatgccaagcaacagcacagattgcagcaaggattctgattgcaactgctccaacagcgcgccaaacagcgacagcaatgctgctccatgcacgccatgcagctgccgcatctcaaatgtctaccaggagttcaccaacacaagagacatcattgaagctgctcttcctgggctgctgaatcctctcaacaacatcctcaatggaacctccatggcagattacatgaagatggggctgccgctctatgtcattgctgcttctttgaaccttgctctacacaagaactacattgcttttgctcaaaaatgggattatgatcctgctggaacaaatgtcatcgtcaggaacctccgcgacaggatcatcgagtacagcaacaatgtctacaccatcttcaccaagtacctgccgccgctcaccgacaacagcaagagcggcctcaatgcatacatcagatacacaaggaacatcaccttaaatgctctggacaccgtcgccggctggccaatgatgaacacaaatgactaccccattggcaccaatgtcaagttcacaaggatcttgttcaatgacattgttggccctgtggagtactacaagggctctccaacaagagatgacagcagcctccacttcaacctctatgatctcaacaagaagcagctaccaaacaacagcatctccgactacttctacaatggcatgcagctctcctccttgaagttccaaaccttctaccacagctacaaggaatgctatcctcttgggctggatgcaagctatgatgcaaacaatggagttcccatcaggcagctgcaaagcaacagcagaggaacatcatggagcaacaacctctttgaagattggccgctgctctcctccttgaacatggcctccacccaaggaggctatgatgttgccaacatcatagcagaaggagacaccatcagcagcggctgtgatggagatccaagaaccatcagccacaatccagcatatgtcaaccaaaggattcaagccatctatcctgttcagccaacaaatccatcaagctatcctggatatggaagcaccgacaagattggcctcatcaccaccttgattccaaatgacaccacctacctcatcgacctcaatccagaagagatctccaccttccctgctgagctctcatatgacacaaatggaacaaccttgatcgagtacatgaatggcgccgccgccctccagctgatgccaaatcaatatgccaagtacatcatcagcaactatgacatggacacaagcagcagccaaggagttcaagttcgcgtccgcgccgccaccacccaagatggaggaagcctctccatcaccgtcaaccagcaaacacaaacattgaagctctcaaacaccaccaacaccgactacacccagatcgtcatcaagggcaagcaaggatattatggcctcttccctccaactgacagccaaaaccccaagcaaagaacaagcaacatcttccagctgccaaattcatacaacaacaccgccatcatccagaacaattctcaagttcccatcatcctggacaggattgaatttgttcctgtgagcgcgccggcgccagatccttctccagattctggaaagcccatccacaagagcgtgccaaaaactgtcacccagctctccaccaccaaggagatctggagcagcacctcagaatatgccaccaccatcagcttcactggaaatgtctacaatgatgcttccatcaccttccagctgctctcctccggccaggtggtgaaggagttccccttcactggaaatggagtggccagcaagcctggcttccatggaagctcaccaagctgctatgacacaccatatcccttctcccagccagatctctctgttccaaagtacaacaagctgcaagtggtgatgaagagtgatggctacagcaagccatgtgatcttggagattccttccccaacacctttgatgctgagatcgacatcaagttcaacctctctgacacagca

SEQ ID NO: 131 - DNA, 2040 bp, Artificial Sequence
  synthetic nucleotide sequence encoding toxin protein
atgacgccgcagcacctcatcaacctcttcgagaggaacttcatctgggagaacaacaagatcatctcagaaggcatcaacatgaagagcaagaaccaggacatgaaccagcgcctcagctacaacaccaccgtggacaagaacagcaccgacagcttgagaaatgaaacagacatcgagctgaagaacatcaaccatgaagatttcttgaggatgtcagagcatgaaagcattgatccatttgtttctgtctccaccatccaaactggcatcggcattgctggcaagatcctcggcaccctcggcgtccccttcgccggccagatagcttcactctacagcttcatccttggagagctctggccaaaaggaaaaagccaatgggagatcttcatggagcatgtggaggagctcatcgaccagaagatctccacatatgcaaggaacattgctcttgctgatctgaagggccttggagatgctctcgccgtctaccatgagagcttggagagctggatcaagaacaggaacaatgctcgcgccacctcagtggtgaagagccagtacattgctctggagctgctcttcgtccagaagctgccctccttcgccgtcagtggagaagaagttcctctgctgcccatctatgctcaagctgctaacctccacctgctgctgctgagagatgcttcagtttttggcaaggaatggggcctctccaacagccagatctccaccttctacaacaggcaggtggagaggacctccgactacagcgaccactgcgtcaaatggtacagcaccggcctcaacaacctccgcggcaccaatgctgaaagctgggtgagatacaaccagttcagaaaggacatgaccttgatggtgctggatctggtggcgctcttcccttcatatgacaccttggtgtaccccatcaagacaacaagccagctgacaagggaggtgtacacagatgccattggaacagttcatccaaatgcttccttcgcctccaccacctggtacaacaacaacaacaatgttccttccttctccgtcattgaagctgctgtggtgaggaatcctcatctgctggacttcctggagcaggtcaccatctacagcctcctctcaagatggagcaacacccagtacatgaacatgtggggaggccaccgccttgagttcagaaccatcggcggcgccatcaacacctccacccaaggaagcaccaacacctccatcaaccccgtcatcctccccttcacctcaagagatgtctacagaacagaaagcctcgccggcctcaacctcttcctcacccagccggtgaatggagttccaagggtggacttccactggaagttcgccaccctccccattgcttctgacaacttctactaccctggatatgctggaataggaacccagctgcaagattcagaaaatgagctgccgccggagacaaaaggccagccaaactatgaaagctacagccaccgcctcagccacatcggcctcatctccgccagccatgtcaaggcgctggtgtacagctggacccaccgctcagcagaaagaacaaacaccatcgagccaaacagcatcactcagatcccgctggtgaaggccttcaacctctcctccggcgccgccgtggtgaaggggccgcgcttcactggaggtgacatcctccgccgcaccaacaccggcaccttcggcgacatcagggtgaacatcaaccctccatttgctcaaagatacagggtgaggatcagatatgcttcaacaactgatctccagttccacacctccatcaatggccgcgccatcaatcaaggaaacttccccgccaccatgaacagaggagaagatctggagtacaggaccttcagaactgttggcttcaccacccccttctccttctcagacatccagagcaccttcaccatcggcgcctggaacttctcctctggaaatgatgtctacatcgacaggattgaatttgttcctgtggaggtgacatatgaagcagaatat

SEQ ID NO: 132 - DNA, 2040 bp, Artificial Sequence
  synthetic nucleotide sequence encoding toxin protein
atgacgccgcagcatctcatcaacctctttgaaaggaacttcatctgggagaacaacaagatcatctcagaaggcatcaacatgaagagcaagaaccaagacatgaaccaaaggctcagctacaacaccaccgtggacaagaacagcaccgacagcttgagaaatgaaacagacattgagctgaagaacatcaaccatgaagatttcttgaggatgtcagaacatgaaagcattgatccatttgtttctgtttccaccatccaaactggcattggaattgctggaaagatccttggaaccctcggcgtccccttcgccggccaaatagcttcactctacagcttcatccttggagagctctggccaaaaggaaaaagccaatgggagatcttcatggagcatgtggaggagctcatcgaccagaagatctcaacatatgcaagaaacattgctcttgctgatctgaagggccttggagatgctcttgctgtctaccatgagagcttggagagctggatcaagaacagaaacaatgcaagagccacctcagtggtgaagagccagtacattgctctggagctgctcttcgtccagaagctgccatccttcgccgtcagtggagaagaagttcctcttcttcccatctatgctcaagctgctaatctccatctgctgctgctgagagatgcttcagtttttggaaaagaatggggcctctccaacagccagatctccaccttctacaacaggcaggtggagaggacatcagactacagcgaccactgcgtcaaatggtacagcactggcctcaacaacctccgcggcacaaatgctgaaagctgggtgagatacaaccagttcagaaaggacatgacattgatggtgctggatctggtggcgctcttcccttcatatgacaccttggtgtaccccatcaaaacaacaagccagctgacaagagaggtgtacacagatgccattggaacagttcatccaaatgcttccttcgcctccaccacctggtacaacaacaacaacaatgttccttccttctccgtcattgaagctgctgtggtgagaaatcctcatctgctggacttcttggagcaagtcaccatctacagcttgctctcaagatggagcaacacccagtacatgaacatgtggggaggccaccgccttgagttcagaaccatcggcggcgccatcaacacctccacccaaggaagcaccaacacctccatcaatcctgtcatcctccccttcacctcaagagatgtctacagaacagaaagcctcgccggcctcaacctcttcctcacccagccagtgaatggagttccaagggtggacttccattggaagtttgccaccctccccattgcttctgacaacttctactatcctggatatgctggaataggaacacagctgcaagattcagaaaatgagctgccgccagaaacaaaaggacaaccaaattatgaaagctacagccaccgcctcagccacattggcctcatctccgccagccatgtcaaggcgctggtgtacagctggacccacagatcagcagaaagaacaaacaccatcgagccaaacagcatcactcagattcctctggtgaaggccttcaacctctcctccggcgccgccgtggtgaaggggccaaggttcactggaggtgacatcctccgccgcaccaacactggaacctttggagacatcagggtgaacatcaatcctccatttgctcaaagatacagggtgaggatcagatatgcttcaacaactgatcttcagttccacacctccatcaatggccgcgccatcaatcaaggaaacttccctgccaccatgaacagaggagaagatctggagtacagaaccttcagaactgttggcttcaccacccccttctccttctcagacatccaaagcaccttcaccatcggcgcctggaacttctcttctggaaatgatgtctacattgacaggattgaatttgttcctgtggaggtgacatatgaagcagaatat

SEQ ID NO: 133 - DNA, 2163 bp, Artificial Sequence
  synthetic nucleotide sequence encoding toxin protein
atgaagagcaagaaccaggacatgaaccagcgcctcagctacaacaccaccgtggacaagaacagcaccgacagcttgagaaatgaaacagacatcgagctgaagaacatcaaccatgaagatttcttgaggatgtcagagcatgaaagcattgatccatttgtttctgtctccaccatccaaactggcatcggcattgctggcaagatcctcggcaccctcggcgtccccttcgccggccagattgcttcactctacagcttcatccttggagagctctggccaaaaggaaaaagccaatgggagatcttcatggagcatgtggaggagctgattgatcagaagatctccacatatgcaaggaacattgctcttgctgatctgaagggccttggagatgctctcgccgtctaccatgagagcttggagagctggatcaagaacaggaacaatgctcgcgccacctcagtggtgaagagccagtacattgctctggagctgctcttcgtccagaagctgccctcctttgctgtttctggagaagaagttcctctgctgcccatctatgctcaagctgctaacctccacctgctgctgctgagagatgcttctgtttttggcaaggaatggggcctctccaacagccagatctccaccttctacaacaggcaggtggagaggacatcagattattcagatcactgcgtcaaatggtacagcaccggcctcaacaacctccgcggcaccaatgctgaaagctgggtgagatacaaccagttcagaaaggacatgaccttgatggtgctggatctggtggcgctcttcccaagctatgacaccttggtgtaccccatcaagacaacatcacagctgacaagggaggtgtacacagatgccatcggcaccgtccatccaaatgcttccttcgcctccaccacctggtacaacaacaacaacaatgttccttccttctccgtcattgaagctgctgtggtgaggaatcctcatctgctggacttcctggagcaggtcaccatctacagcctcctctcaagatggagcaacacccagtacatgaacatgtggggaggccaccgccttgagttcagaaccatcggcggcgccatcaacacctccacccaaggaagcaccaacacctccatcaaccccgtcatcctccccttcacctcaagagatgtctacagaacagaaagcctcgccggcctcaacctcttcctcacccagccggtgaatggagttccaagggtggacttccactggaagttcgccaccctccccattgcttctgacaacttctactaccctggatatgctggaataggaacccagctgcaagattcagaaaatgagctgccgccggagacaaaaggccagccaaactatgaaagctacagccaccgcctcagccacatcggcctcatctccgccagccatgtcaaggcgctggtgtacagctggacccaccgctcagcagaaagaacaaacaccatcgagccaaacagcatcactcagatcccgctggtgaaggccttcaacctctcctccggcgccgccgtggtgaaggggccgcgcttcactggaggtgacatccttcgccgcaccaacaccggcaccttcggcgacatcagggtgaacatcaaccctccatttgctcaaagatacagggtgaggatcagatatgcttcaacaactgatctccagttccacacctccatcaatggccgcgccatcaatcaaggaaacttccccgccaccatgaacagaggagaagatctggagtacaggaccttcagaactgttggcttcaccacccccttctccttctcagacatccagagcaccttcaccattggagcatggaacttctcctctggaaatgatgtctacatcgacaggattgaatttgttcctgtggaggtgacatatgaagcagaatatgattttgagaaggctcaagaagaggtgacggcgctcttcacctccaccaaccccaagggcctcaagacagatgtcaccgactaccacattgatcaagtttcaaacctggtggagagcctctctgatgagttctacctggatgagaagagggagctcttcgagatcgtcaaatatgcaaggcagctcaacatcgagaggaacatg

SEQ ID NO: 134 - DNA, 2163 bp, Artificial Sequence
  synthetic nucleotide sequence encoding toxin protein
atgaagagcaagaaccaagacatgaaccaaaggctcagctacaacaccaccgtggacaagaacagcaccgacagcttgagaaatgaaacagacattgagctgaagaacatcaaccatgaagatttcttgaggatgtcagaacatgaaagcattgatccatttgtttctgtctccaccatccaaactggcattggcattgctggaaagatcctcggcaccctcggcgtccccttcgccggccaaattgcttcactctacagcttcatccttggagagctctggccaaaaggaaaaagccaatgggagatcttcatggagcatgtggaggagctgattgatcagaagatctcaacatatgcaaggaacattgctcttgctgatctgaagggccttggagatgctcttgctgtctaccatgagagcttggagagctggatcaagaacaggaacaatgcaagggccacttctgtggtgaagagccagtacattgctctggagctgctcttcgtccagaagctgccatcatttgctgtttctggagaagaagttcctctgctgcccatctatgctcaagctgctaatctccatctgctgctgctgagagatgcttctgtttttggaaaagaatggggcctctccaacagccagatctccaccttctacaacaggcaggtggagagaacatcagattattcagatcactgcgtcaaatggtacagcaccggcctcaacaacctccgcggcacaaatgctgaaagctgggtgagatacaaccagttcagaaaggacatgacattgatggtgctggatctggtggcgctcttcccaagctatgacaccttggtgtaccccatcaaaacaacatcacagctgacaagggaggtgtacacagatgccattggcaccgtccatccaaatgcttccttcgcctccaccacctggtacaacaacaacaacaatgttccttccttctccgtcattgaagctgctgtggtgagaaatcctcatctgctggacttcttggagcaggtcaccatctacagcttgctctcaagatggagcaacacccagtacatgaacatgtggggaggccaccgccttgagttcagaaccatcggcggcgccatcaacacctccacccaaggaagcaccaacacctccatcaaccctgtcatcctccccttcacctcaagagatgtctacagaacagaaagcctcgccggcctcaacctcttcctcacccagccagtgaatggagttccaagggtggacttccactggaagttcgccaccctccccattgcttctgacaacttctactatcctggatatgctggaataggaacacagctgcaagattcagaaaatgagctgccgccagaaacaaaaggacaaccaaattatgaaagctacagccaccgcctcagccacattggcctcatctccgccagccatgtcaaggcgctggtgtacagctggacccaccgctcagcagaaagaacaaacaccatcgagccaaacagcatcactcagattcctctggtgaaggccttcaacctctcctccggcgccgccgtggtgaaggggccaaggttcactggaggtgacatccttcgccgcaccaacactggaacctttggagacatcagggtgaacatcaatcctccatttgctcaaagatacagggtgaggatcagatatgcttcaacaactgatcttcagttccacacctccatcaatggccgcgccatcaatcaaggaaacttccctgccaccatgaacagaggagaagatctggagtacagaaccttcagaactgttggcttcaccacccccttctccttctcagacatccaaagcaccttcaccattggagcatggaacttctcttctggaaatgatgtctacatcgacaggattgaatttgttcctgtggaggtgacatatgaagcagaatatgattttgagaaggctcaagaagaagtgacggcgctcttcacctccaccaacccaaaaggcctcaaaacagatgtcaccgactaccacattgatcaagtttcaaatttggtggagagcctctctgatgagttctacctggatgagaagagggagctctttgagattgtcaaatatgcaaggcagctcaacattgaaaggaacatg

SEQ ID NO: 135 - DNA, 960 bp, Artificial Sequence
  synthetic nucleotide sequence encoding toxin protein
atggtgaggatctacccgcgcctcaatgagctcatcagagaagctgcaaggaaatgggcggagaacaaccagttcagattcttgaggagcaccctgctggaccctgacaccaatgatgaaacagtggtgatgaacaccaccttcacagagattggctctccagaagaatgcatggatctggagcctcttcagatcaagcaatcattcaccaacaacaccgaccagcaaacaacagagatcttcagagatgttgtttatgtggaggatgatttcacctgggagaatgaatatgagttcaacatctccgagctgaagctgctcaccatcccgcgcgtccccaagctggcctacaaggacatcaaccctggcttccaggtggacctcttcggccccaacagggtgttctcaacaaagatgagggagatgaggccgctccgcgctgaggtgttcctggagcctcattcttctgtcaacctcaaggccaaggtggagaggcagcagttcagccaggagtaccagctggagctctccatccaaggagatgtggtggtgacaactgaaagaacaactggagaatcagaagaatattatgtcagcttgagagatctcatccccttcttcgtgctgccaaacaacttcaccttggaaggacaagctctggtgttcagagagaagggcaagttcaccggcatcctctaccgcgccatccacctctatgtcacccaaaccctctacaatgaaaggaagatcctggaatatgagatcccgctgctgccgccgctggatgatctgagatcaaggctggtggaggccatcggcgcgcgccgcctctctcctcaagaagatgagttcaccgtcgtcagcagcaccagccaaacagttcctcccaaggagcaagatcaatgtggatgcagcagctgcttgagcagccaaagcaacaccaacctctacacagatcaa

SEQ ID NO: 136 - DNA, 960 bp, Artificial Sequence
  synthetic nucleotide sequence encoding toxin protein
atggtgaggatctacccaaggctcaatgagctcatcagagaagctgcaagaaaatgggcagaaaacaaccagttcagattcttgagaagcaccttgctggaccctgacaccaatgatgaaacagtggtgatgaacaccaccttcacagaaattggatctccagaagaatgcatggatctggagcctcttcagatcaagcaatcattcaccaacaacacagatcagcaaacaacagagatcttcagagatgttgtttatgttgaagatgatttcacctgggaaaatgaatatgagttcaacatctcagagctgaagctgctcaccatcccgcgcgtccccaagctggcctacaaggacatcaaccctggcttccaggtggatctcttcggccccaacagggtgttctcaacaaagatgagggagatgaggccgctgagagctgaggtgttcttggagcctcattcttctgtcaacctcaaggccaaggtggagaggcagcagttcagccaagagtaccagctggagctctccatccaaggagatgtggtggtgacaactgaaagaacaactggagaatcagaagaatattatgtcagcttgagagatctcatccccttcttcgtgctgccaaacaacttcaccttggaaggacaagctctggtgttcagagaaaaaggcaagttcaccggcatcctctacagggccatccacctctatgtcacccaaaccctctacaatgaaaggaagatcctggaatatgagattcctctgctgccgccgctggatgatctgagatcaaggctggtggaggccatcggcgcgcgccgcctctctcctcaagaagatgagttcaccgtcgtcagcagcaccagccaaacagttcctccaaaggagcaagatcaatgtggatgcagcagctgcttgagcagccaaagcaacaccaacctctacacagatcaa

SEQ ID NO: 137 - DNA, 996 bp, Artificial Sequence
  synthetic nucleotide sequence encoding toxin protein
atgaaaacctgcaccaacaacagcaacccaaggaacaccgtgctgctggagctggatgactacatcacccatgtggtgaaggagaatgtggtgctggggccgccagatctggtgggaaggaagatgggatatcctcctggccttggaagctggaggatggattcaagctacttcccaacaccaacaagcagccaagttcctgggccgccgtgcaacaccaccttcacctgccgatattatccttcaccagcatggggctacaacaccaacagcatgattgctgaaggcatcaacaaggtgattgaagcagaaacagtggcgctggcgcagcccatcatcatggacatccacaacttcagcaacaacaccaatgtgcagcaaacatactacacaccagaatattcagaagtcaccaccaccaccgtcaccaacagcaccaccagcggcatcaagagcggcaccaagatctccgcctccgtcaagttcaagatcttgaaggctgaatttggcgtcaacacagaagtttcttcagagtacaacttctccaccacccaaaccatcaccaccaccaccagcaggaccgtcaccttcaaggctcagccggtggtggtggcgccgcacaccaccgtccaggtcaccgtgctgctgaacagggtggtgtaccaaaatgaagctgttccaattgaagcagatctctctggaaggatctactcagatgatggcagcgtcggcctggacttctaccccaccttcgagttcttcaacagatgctgcggcacagcagaatgctgcaagctgccggacagcttgaagattggaagcaacaacaaggtgaggttcaccggcattggctacttccaatcagatgttccaagcaacaacttccagatcaccaccgacatcattgatgatgccaccggcgccaccatcagcagagatgttcagtttgttccagcaacatttggccccatcctcggcaccaccacctccaccagc

SEQ ID NO: 138 - DNA, 996 bp, Artificial Sequence
  synthetic nucleotide sequence encoding toxin protein
atgaaaacatgcaccaacaacagcaatccaagaaacaccgtgctgctggagctggatgattacatcacccatgtggtgaaggaaaatgtggtgctggggcctccagatcttgttggaaggaagatgggatatcctcctggccttggaagctggaggatggattcaagctacttcccaacaccaacaagcagccaagttcctgggcctccatgcaacaccaccttcacctgccgatattatccttcaccagcatggggctacaacaccaacagcatgattgctgaaggcatcaacaaggtgattgaagcagaaacagtggcgctggcgcagcccatcatcatggacatccacaacttcagcaacaacacaaatgttcaacaaacatactacacaccagaatattcagaagtcaccaccaccaccgtcaccaacagcaccacctctggcatcaagagcggcaccaagatctccgcctccgtcaagttcaagatcttgaaggctgaatttggtgtcaacacagaagtttcttcagaatacaacttctccaccacccaaaccatcaccaccaccacctcaagaactgtcaccttcaaagctcaaccagtggtggtggcgccgcacaccaccgtccaagtgacagtgctgctgaacagggtggtgtaccaaaatgaagctgttccaattgaagcagatctttctggaaggatctattcagatgatggaagcgtcggcctggacttctaccccaccttcgagttcttcaacagatgctgtggaacagcagaatgctgcaagctgccagacagcttgaagattggaagcaacaacaaggtgaggttcactggcattggatacttccaatcagatgttccaagcaacaacttccagatcaccaccgacatcattgatgatgccaccggcgccaccatctcaagagatgttcaatttgttccagcaacatttggacccatccttggcaccaccacctccaccagc

SEQ ID NO: 139 - DNA, 2028 bp, Artificial Sequence
  synthetic nucleotide sequence encoding toxin protein
atgaacaggaacaaccaaaatgaatatgagatcattgatgctcctcattgtggctgcccttctgatgatgtggtgaagtacccgctgacagatgatccaaatgctggcctccagaacatgaactacaaggagtacctccagatgtatggaggagactacacagatcctctcatcaaccccaacctctctgtctcaggcaaggatgtcatccaggtgggcatcaacattgttggaaggctgctgagcttcttcggcttccccttcagcagccaatgggtcaccgtctacacctacctcctcaacagcctctggccagatgatgaaaattctgtttgggatgccttcatgaagagggtggaggagctcatcgaccagaagatctcagaagctgtcaagggccgcgcgctggatgatctcaccggcctccaggagaactacaacctctatgttgctgctctggatgaatggctcaacaggccaaatggcgcgcgcgcctccttggtgagccaaaggttcaacatcctggacagcctcttcacccagttcatgccctcctttggatcaggacctggaagccagaactacgccaccatcctgctgccagtttatgctcaagctgcaaatcttcatctgctgctgctgaaggatgctgacatctatggagcaagatggggcctcaaccaaacccagatcgaccagttccattcaaggcagcagagcctcaccctcacctacaccaaccactgcgtcaccgcctacaatgatggcctcgccgagctccgcggcacctccgtggagagctggctgaagtaccaccagtacaggagggagatgaccgtcaccgccatggatctagtggcgctcttcccctactacaatgtccgccaatatccaaatggagcaaatcctcagctgacaagggaggtgtacactgatcccatcgtgttcaacccgccggagcatccttctggcttcttctgcgagagcttctacaccatccgcgccgccagggagaggctcaccttctcccagcttgaaaatgccatcatcaggccgccgcggctatttgaaaggttccaagctcttggcatctacactggagagctccagctgggccaaggaagcacgccgatgaaccactggattggccacttcatcaggaacacaaggctgggagattccaccaccatcaccaccaactatggcaccaccaacaacaggctcaccaacttcatccctccaacaacatcagatgtctaccagatcaacagcatcagcagcaatgctgctagcttcctcaacaccttcttcggcgtgacaagagctcagttccactatggcagcggcatcatctggagctatgttggccagaacaatgttcttcctccctgcctccagaactacaacagcatcgaggagctgccaaatcaaagtgaagaaccaacagtgaggagctacagccaccgcctctcacacatcaccagcttcaacttcaatgtgcagctcaactcgccgctgaggagcagcggcaacatgccagtttatgtttggacccaccgctctgttgatctcaacaacaccatcaccagcgacaggatcacccagctgcccgccgtcaaggcctccaccctcggcgccggcgccatcgtggtgaaggggccaggcttcactggaggtgatgtcatcagaagaacatcagttggaaattttggaaggatcagggtcaccgtcaactcgccgctcacccagcgctacaggatcaggttcagatatgcttccaccaccgacctccagattggcatcaatgttggcaacaggacggtgaacctcttcgacttcccttcaacaatgaacagcggccaagaaagcaaatatgagagcttcgtcaccagggagttcaccaccgccttctccttcacccaaacacaagaaaccatctccgcctttgctcagagcttctcctccggccaggtgtacctggacaggattgagatcatccccgtcaacccagcaagagaagcagaagaa

SEQ ID NO: 140 - DNA, 2028 bp, Artificial Sequence
  synthetic nucleotide sequence encoding toxin protein
atgaacagaaacaaccaaaatgaatatgagatcattgatgctcctcattgtggctgcccttctgatgatgtggtgaagtatcctctgacagatgatccaaatgctggcctccaaaacatgaactacaaggagtacctccagatgtatggaggagattacacagatcctctcatcaaccccaacctctctgtctcaggaaaagatgtcatccaagttggcatcaacattgttggaaggctgctgagcttctttggcttccccttcagcagccaatgggtcaccgtctacacctacctcctcaacagcttgtggccagatgatgaaaattctgtttgggatgccttcatgaagagggtggaggagctcatcgaccagaagatttcagaagctgtcaaaggaagggcgctggatgatctcactggcctccaagaaaactacaacctctatgttgctgctcttgatgaatggctcaacaggccaaatggagctcgcgcctccttggtgagccaaagattcaacatcttggacagcttgttcacccagttcatgccatcatttggatcaggacctggaagccaaaactatgccaccatcctgcttcctgtttatgctcaagctgcaaatcttcatctgctgctgctgaaggatgctgacatctatggagcaagatggggcctcaaccaaacacagattgatcagttccattcaaggcagcagagcttgaccttgacctacaccaaccactgcgtcaccgcctacaatgatggcctcgccgagctccgcggcacctccgtggagagctggctgaagtaccatcagtacagaagagagatgacagtcaccgccatggatctagttgctctcttcccctactacaatgttcgccaatatccaaatggagcaaatcctcagctgacaagagaggtgtacactgatcccattgttttcaaccctccagagcatccttctggcttcttctgcgagagcttctacaccatccgcgctgcaagagaaaggctcaccttctcccagcttgaaaatgccatcatcaggccgccgcggctatttgaaagattccaagctcttggcatctacactggagagctccagctgggacaaggaagcacgccgatgaaccattggattggccacttcatcaggaacacaaggcttggagattccaccaccatcaccaccaactatggaaccaccaacaacaggctcaccaacttcattcctccaacaacatcagatgtctaccagatcaacagcatcagcagcaatgctgctagcttcctcaacaccttctttggagtgacaagagctcagttccattatggaagcggcatcatctggagctatgttggacaaaacaatgttcttcctccatgcctccaaaactacaacagcattgaggagctgccaaatcaaagtgaagaaccaacagtgagaagctacagccaccgcctctcacacatcaccagcttcaacttcaatgttcagctcaactcgccgctgagaagctctggcaacatgccagtttatgtttggacccaccgctctgttgatctcaacaacaccatcaccagcgacaggatcacccagctgcctgctgtcaaggcctccaccctcggcgccggcgccattgtggtgaaaggacctggcttcactggaggtgatgtcatcagaagaacatcagttggaaattttggaaggatcagggtcaccgtcaactcgccgctcacccagcgctacaggatcagattcagatatgcttccaccacagatctccagattggcatcaatgttggaaacaggactgtcaacctcttcgacttcccttcaacaatgaacagcggccaagaaagcaaatatgagagcttcgtcacaagggagttcaccaccgccttctccttcacccaaacacaagaaaccatctctgcttttgctcagagcttctcctctggccaggtgtacctggacaggattgagatcatccctgtcaatccagcaagagaagcagaagaa

SEQ ID NO: 141 - DNA, 2034 bp, Artificial Sequence
  synthetic nucleotide sequence encoding toxin protein
atgaacatcaatgacaacaaggatgaatttgagatcatgggaaatggaagcatggtgtaccagccaagatatcctcttgctcaagctcctggatcagagttccaagggatgaactacaaggactggatgaacagatgtgcaaatggagagctgggagagctcttcgtggattctgatgctgtcagaaatggcatcgtcgccggcctcggcgtcaccagcttcgtcctctccatcggcttccctgctgctgctgctgccgtaggcatcatctcagtgctgctgccgctgctctggcctgatcaagctggacctcctggaacaacagaagctcagttcacctgggatcaatggatcactgctggagaagagctggctgctcaaactgtctccacctccgtcaaggaccgcgccatcgacacaacaaggattcttcaatcaaggatgagggactaccagcaggccatctgcaacctccaaacagatccagacaatgaagaatacaaggctgatgtgaggagggagttcaatgatgctgaagatcaagcaaaggatgctgtcatccagtttggcaacctcaactacgccatccctctacttgctgattatgctgaagctgccaacctccacctgctgctgctgagagatgtggtgaagtttggagagatctggggcttcaccgccctccaggtgcagcagtactactcaaacaccggcgtcggcaaccctgggatgaagcagctgctggccacctacacagatcactgcgtccgctactacaaggaagggctggagaagagatatgccaccggcaactggaatgccttcaatgactacagaagaacaatgaccatcatggtgatggacattgtttcattgtggccaacatatgacagcagggtgtacaccctccccaccaagagccagctgacaaggacggtgtacacccccttcgtgctgagctacccaacaccaaatcttcctctcatctcagagattgaaagccaggtggtggtgccgccaagcctcttcagctggctcttcctcatcgagagctacacagagaaggctgctcaagacaaggaatgcttgacagggcagcgccaagccttcgcctacaccactggaagagatctcttccaggagttcaagggcaacctaaatggcacctacagaggccagctggtggctgaacctggcctcggccaatatgtttgggccatcgagctctatggcagcggctacctctgggatggatatccatatctccacaacctgggcttcttcaacttcaagctgacaaattcagaagatcagaagatccatgtttctcctggagacattgttgatggcaccaccgccatcctcggcctcccctgcaagccaaacaacaatgattgtgatccatgcaacccctgcaacaccctccccatcaacctctcaaatccatgcaatgacatctccctctacagccaccgcttcagctacctcggcacctacccggcgccgccggtgaacaactggagccccaccaacatcggcaacttctcatttggatggacccacatctccgccgactatgagaaccagattgatgctgagaagatcacccagatccccgccgtcaaggctgatggcatgggcagcaccgtgaagatcatcaaaggagatggatcaactggaggagatctggtgcagctgggccaaggaccaagccatgccaccttcctcaagatccccatgggcggcattgctcagaagggctaccagctgaggatcagatatgctctctctgcaagagaagattctgagctggtggtggagaggctggtgggcaacagaggagacatggtgagggactactatgcttcaacatggatgacgccaacatattctggagatcctctccaggtgaactatgacagctttggatatgccaccttcgagagcttgctgccgccgacgccatacagcaactgggagctcatcttcgccggcgacaccgcgctcatcgacaagatcgagttcatccccatc

SEQ ID NO: 142 - DNA, 2034 bp, Artificial Sequence
  synthetic nucleotide sequence encoding toxin protein
atgaacatcaatgacaacaaggatgaatttgagatcatgggaaatggaagcatggtgtaccagccaagatatcctcttgctcaagctcctggatcagagttccaaggaatgaactacaaggattggatgaacagatgtgcaaatggagagcttggagagctctttgttgattctgatgctgtcagaaatggcatcgtcgccggcctcggcgtcaccagcttcgtcctctccattggcttccctgctgctgctgctgccgtaggcatcatctcagtgctgctgccgctgctctggcctgatcaagctggacctcctggaacaacagaagctcagttcacctgggatcaatggatcactgctggagaagagcttgctgctcaaacagtttccacctccgtcaaggaccgcgccatcgacacaacaaggattcttcaatcaaggatgagggactaccagcaagccatctgcaacctccaaacagatccagacaatgaagaatacaaagctgatgtcagaagggagttcaatgatgctgaagatcaagcaaaagatgctgtcatccagtttggaaacctcaactatgccattcctctacttgctgattatgctgaagctgcaaacctccatctgctgctgctgagagatgtggtgaagtttggagagatctggggcttcactgctctccaggtgcagcagtactattcaaacaccggcgtcggcaatccagggatgaagcagctgctggccacctacacagatcactgcgtcagatactacaaggaagggctggagaagagatatgcaactggcaactggaatgccttcaatgattacagaagaacaatgaccatcatggtgatggacattgtttcattgtggccaacatatgattcaagggtgtacaccctccccaccaagagccagctgacaaggacggtgtacacccccttcgtgctgagctatccaacaccaaatcttcctctcatctcagaaattgaaagccaggtggtggtgcctccttctctcttcagctggctcttcctcattgaaagctacacagaaaaagctgctcaagacaaggaatgcttgacagggcagaggcaagccttcgcctacacaacaggaagagatctcttccaggagttcaaaggaaatctaaatggaacatacagaggccagctggtggctgaacctggccttggacaatatgtttgggccatcgagctctatggaagtggctacctctgggatggatatccatatcttcacaaccttggcttcttcaacttcaagctgacaaattcagaagatcagaagatccatgtttctcctggagatattgttgatggcaccaccgccatcctcggcctgccatgcaagccaaacaacaatgattgtgatccatgcaacccctgcaacaccctccccatcaacctctcaaatccatgcaatgacatctccttgtacagccaccgcttcagctaccttggaacctacccggcgccgccggtgaacaactggagccccaccaacattggaaacttctcatttggatggacacacatctccgccgactatgaaaaccaaattgatgctgagaagatcacccagatccctgctgtcaaggctgatggcatgggaagcacagtgaagatcatcaaaggagatggatcaactggaggagatctggtgcagctgggccaaggaccaagccatgcaaccttcttgaagatccccatgggaggaattgctcaaaaaggctaccagctgaggatcagatatgctctttctgcaagagaagattctgagctggtggtggagaggctggtgggcaacagaggagacatggtgagggactactatgcttcaacatggatgacaccaacatattctggagatcctcttcaagtgaactatgacagctttggatatgcaacctttgagagcttgctgccgccgacgccatacagcaactgggagctcatcttcgccggcgacaccgcgctcatcgacaagattgagttcatccccatc

SEQ ID NO: 143 - DNA, 1926 bp, Artificial Sequence
  synthetic nucleotide sequence encoding toxin protein
atgaactacaaggactggatgaacagatgtgcaaatggagagctgggagagctcttcgtggattctgatgctgtcagaaatggcattgttgctggcctcggcgtgacctccttcgtcctctccatcggcttccctgctgctgctgctgctgttggcatcatctcagtgctgctgccgctgctctggcctgatcaagctggacctcctggaacaacagaagctcagttcacctgggatcaatggatcactgctggagaagaactagctgctcaaactgtctccacctccgtcaaggaccgcgccatcgacacaacaaggatcttgcaaagcaggatgagggactaccagcaggccatctgcaacctacaaacagatccagacaatgaagaatacaaggctgatgtgaggagggagttcaatgatgctgaagatcaagcaaaggatgctgtcatccagtttggcaacctcaactacgccatcccgctgctggcagattatgctgaagctgccaacctccacctgctgctgctacgagatgtggtgaagtttggagagatctggggcttcaccgccctccaggtgcagcagtactacagcaacaccggcgtcggcaaccctgggatgaagcagctgctggccacctacacagatcactgcgtccgctactacaaggaagggctagagaagagatatgccaccggcaactggaatgccttcaatgactacagaagaacaatgaccatcatggtgatggacatcgtcagcctctggccaacatatgacagcagggtgtacaccctgccaacaaagagccagctgacaaggacggtgtacacccccttcgtgctgagctaccccacccccaacctgccgctcatctcagagattgaaagccaggtggtggtgccgccaagcctcttcagctggctcttcctcatcgagagctacacagagaaggctgctcaagacaaggagtgcctcaccggccagcgccaagccttcgcctacaccactggaagagatctcttccaggagttcaagggcaacctaaatggcacctacagaggccagctggtggcagaacctggcctcggccaatatgtttgggccattgagctctatggcagcggctacctctgggatggatatccatatctccacaacctgggcttcttcaacttcaagctcaccaactcagaagatcagaagatccatgtgagccctggagacattgttgatggcaccaccgccatcctcggcctcccctgcaagccaaacaacaatgattgtgatccatgcaacccctgcaacaccctccccatcaacctctcaaatccatgcaatgacatctccctctacagccaccgcttcagctaccttggaacatatccggcgccgccggtgaacaactggagccccaccaacatcggcaacttctcatttggatggacccacatctccgccgactatgagaaccagattgatgctgagaagatcacccagatccccgccgtcaaggctgatggcatgggcagcaccgtgaagatcatcaaaggagatggatcaactggaggagatctggtgcagctgggccaaggaccaagccatgccaccttcctcaagatccccatgggcggcattgctcagaagggctaccagctgaggatcagatatgctctctctgcaagagaagattctgagctggtggtggagaggctggtgggcaacagaggagacatggtgagggactactatgcttcaacatggatgacgccaacatattctggagatcctctccaggtgaactatgacagctttggatatgccaccttcgagagcttgctgccgccgacgccatacagcaactgggagctcatctttgctggagacaccgcgctcatcgacaagatcgagttcatccccatc

SEQ ID NO: 144 - DNA, 1926 bp, Artificial Sequence
  synthetic nucleotide sequence encoding toxin protein
atgaactacaaggattggatgaacagatgtgcaaatggagagcttggagagctctttgttgattctgatgctgtcagaaatggcattgttgctggcctcggcgtgacctccttcgtcctctccattggcttccctgctgctgctgctgctgttggcatcatctcagtgctgctgccgctgctctggcctgatcaagctggacctcctggaacaacagaagctcagttcacctgggatcaatggatcactgctggagaagaactagctgctcaaacagtttccacctccgtcaaggaccgcgccatcgacacaacaaggattcttcaaagcaggatgagggactaccagcaagccatctgcaacctacaaacagatccagacaatgaagaatacaaagctgatgtcagaagagagttcaatgatgctgaagatcaagcaaaagatgctgtcatccagtttggaaacctcaactatgccatccctctgctggcagattatgctgaagctgcaaacctccatctgctgctgctacgagatgtggtgaagtttggagaaatctggggcttcactgctctccaggtgcagcagtactacagcaacaccggcgtcggcaatccagggatgaagcagctgctggccacctacacagatcactgcgtcagatactacaaggaaggactagagaagagatatgcaactggcaactggaatgccttcaatgattacagaagaacaatgaccatcatggtgatggacatcgtcagcttgtggccaacatatgattcaagggtgtacaccttgccaacaaaaagccagctgacaaggacggtgtacacccccttcgtgctgagctatccaaccccaaaccttcctctcatctcagaaattgaaagccaggtggtggtgcctccttctctcttcagctggctcttcctcattgaaagctacacagaaaaagctgctcaagacaaggaatgcctcaccggccaaaggcaagccttcgcctacacaacaggaagagatctcttccaggagttcaaaggaaatctaaatggaacatacagaggccagctggtggcagaacctggccttggacaatatgtttgggccattgagctctatggaagtggctacctctgggatggatatccatatcttcacaaccttggcttcttcaacttcaagctcaccaattcagaagatcagaagatccatgtgagccctggagatattgttgatggcaccaccgccatcctcggcctgccatgcaagccaaacaacaatgattgtgatccatgcaacccctgcaacaccctccccatcaacctctcaaatccatgcaatgacatctccttgtacagccaccgcttcagctatcttggaacatatccagcgccgccggtgaacaactggagccccaccaacattggaaacttctcatttggatggacacacatctccgccgactatgaaaaccaaattgatgctgagaagatcacccagatccctgctgtcaaggctgatggcatgggaagcacagtgaagatcatcaaaggagatggatcaactggaggagatctggtgcagctgggccaaggaccaagccatgcaaccttcttgaagatccccatgggaggaattgctcaaaaaggctaccagctgaggatcagatatgctctttctgcaagagaagattctgagctggtggtggagaggctggtgggcaacagaggagacatggtgagggactactatgcttcaacatggatgacaccaacatattctggagatcctcttcaagtgaactatgacagctttggatatgcaacctttgagagcttgctgccgccgacgccatacagcaactgggagctcatctttgctggagacaccgcgctcatcgacaagattgagttcatccccatc

SEQ ID NO: 145 - DNA, 2058 bp, Artificial Sequence
  synthetic nucleotide sequence encoding toxin protein
atgaaccagaactacaacaacaatgaatatgagatgatgggcaccggcggcatggactaccagccaagatatcctctcaccaatgctcctggatcagagttccagcagatggactacaaggactggatggacatgtgcaccaatgaatctgttggagatgtttttggagacaccgccaatgctgtcagagatggcctcatcatcggcaccggcgtcgcctgggcgctgctggggctgatcccggtggtgggaggaccagcttcagccattgctggcctcttcaatgtgctgctgccatattggtggcctgaacaagctggagctcctggaactcctcaagctcagttctcatggaaccagctgatgacagctgctgaagagatggtggacaagaagatcctggagagcaagagaggagaagcaacagcaagatggcaaggcatccagctgctgggaagagactactacagcgcgctctgcgactggatcaatgatcaagacaatgctgtgaagaaggagaggctacgagatgcttttgatgatctggatgatcagctgaagctggccatgcccttcttctctgttcaaggcttcgagctgccaatgctctccatgtatgctcaagctgccaacatgcacctgctgctgctgagagatgtggtgcaaaatggcgtcagctggggctttgctccatatgaggtggacagatattattttgatccatcaggacaaagaagccctggcctcctccagctgctgggcatctacaccaactactgcgtggaatggtatgagaagggcctccaggagcagtacaacactggaagatgggagaagttcaacaacttcagaaggaacatgaccatcatggtgctggacaccgtcgccatctggccaacatttgatccaagaagatatcctctccccaccaagagccagctaacaaggacgctctacaccaaccctgttggaagaggaggctacagggagaacatggacagcttggagaatgatctggtggcgccgccgcagctcttcacctggctgagggagattgagatccctgttggcatcgtctacctggatgaccgcgcgccgctgctctgcaagcaaaccctccagaggacgctctcaagcaccacctggagcatcacccaaggagagatcaccacgccggtgatcgacaccctcaccctcaccatcgagaacccctactaccaagatgatgtttggaaggtgaacacccatggcatctctggaggaacagacaccgtcaccggctggaccttcaacttcatcaagagcccagatcaaaccttgatggtgaacaacaacatccatcctggatcagtcaccgacagatggagcggcttcccctgccgaggaaatgattctgtcatctgtgatccatgtgattttgagaacacctgccgcaaggagacaccaaacacctccgtgccatgtgatgacaagcagcactacagccaccgcctcagctatgttggagctcaaggaggaagaagagatgtttcaactcccttcgagctgatcagatttggatatggatggacccatgtctccgccgacaacaatgtgctggatgagaagaagatcacccagatccccgccgtcaagggctacctcaccaatggcaccgtcatcaaggggccaggaagcaccggcggcaacctggtgaagctctcagaaaatgatgatctcaacatcaatgttgctgttcttcctccttctggaagcgcgctggtgtatggctacaacatcaggatcagatatgcttcttctgctgaaacaaggctgctggtggagcaggtgtttgatgacaatggcccctacatctacaacatcccttcaacaagctccgccgacagcttgacatatcagagcttcagctactatgatctctccttccaccacattggacctggcatcattgaaacaccaacaagcagcagcctcttcttccagaacagcggcggcggcgacatcatcatcgacaagatcgagttcatcccaaggaacactcctggagcagaatatgaa

SEQ ID NO: 146 - DNA, 2058 bp, Artificial Sequence
  synthetic nucleotide sequence encoding toxin protein
atgaaccagaactacaacaacaatgaatatgagatgatgggcaccggcggcatggactaccagccaagatatcctctgacaaatgctcctggatcagagttccagcagatggactacaaggattggatggacatgtgcacaaatgaatctgttggagatgtttttggagacacagcaaatgctgtcagagatggcctcatcattggcaccggcgtcgcctgggcgctgctggggctgattcctgtggttggaggaccagcttcagcaattgctggcctcttcaatgtgctgctgccatattggtggcctgaacaagctggagctcctggaactcctcaagctcagttctcatggaaccagctgatgacagctgctgaagagatggtggacaagaagatcctggagagcaaaagaggagaagcaacagcaagatggcaaggcatccagctgctgggaagagattactacagcgcgctctgcgactggatcaatgatcaagacaatgctgtgaagaaggagaggctacgagatgcttttgatgatcttgatgatcagctgaagctggccatgcccttcttctctgttcaaggatttgagctgccaatgctctccatgtatgctcaagctgcaaacatgcatctgctgctgctgagagatgttgttcaaaatggcgtcagctggggatttgctccatatgaggtggacagatattattttgatccatcaggacaaagatctcctggcctcctccagctgctgggcatctacaccaactactgcgtggaatggtatgaaaaaggcctccaggagcagtacaacactggaagatgggagaagttcaacaacttcagaagaaacatgaccatcatggtgctggacaccgtcgccatctggccaacatttgatccaagaagatatcctcttccaaccaagagccagctaacaagaaccttgtacaccaaccctgttggaagaggaggctacagagaaaacatggacagcttggaaaatgatctggtggcgccgccgcagctcttcacctggctgagggagattgagattcctgttggcatcgtctacctggatgatagggcgccgctgctctgcaagcaaaccttgcaaaggacgctctcaagcaccacctggagcatcacccaaggagagatcaccacgccggtgattgacaccttgaccctcaccattgagaacccctactaccaagatgatgtttggaaggtgaacacccatggcatctctggaggaacagacaccgtcactggatggaccttcaacttcatcaagagcccagatcaaacattgatggtgaacaacaacatccatcctggatcagtgacagacagatggagcggcttcccctgccgaggaaatgattctgtcatctgtgatccatgtgattttgaaaacacctgccgcaaggaaacaccaaacacctctgttccatgtgatgacaagcagcactacagccaccgcctcagctatgttggagctcaaggaggaagaagagatgtttcaactccatttgagctgatcagatttggatatggatggacacatgtctccgccgacaacaatgtgctggatgagaagaagatcacccagatccctgctgtcaagggctacctcaccaatggcaccgtcatcaaaggaccaggaagcaccggcggcaacctggtgaagctctcagaaaatgatgatctcaacatcaatgttgctgttcttcctccttctggaagcgcgctggtgtatggctacaacatcaggatcagatatgcttcttctgctgaaacaaggctgctggtggagcaagtttttgatgacaatggaccatacatctacaacatcccttcaacaagctccgccgacagcttgacatatcagagcttcagctactatgatctctccttccaccacattggacctggcatcattgaaacaccaacaagcagcagcctcttcttccagaacagcggcggcggcgacatcatcatcgacaagattgagttcatcccaaggaacactcctggagcagaatatgaa

SEQ ID NO: 147 - DNA, 2067 bp, Artificial Sequence
  synthetic nucleotide sequence encoding toxin protein
atgaacagctatgagaacaagaatgaatatgagatcctggatgcttctcaaaacaacagcaacatgagcaacagatatcaaagatatcctcttgctcacaaccctcaaacatcaatccaaacaacaaactacaaggactggctcaagatgtgccaaaatcctcatcaaaatcctctggacatggaaggatatgacagcaacagcgtggtggtggtgagcaccggcctcatcgtggtgggcaccttgatctccatcctctcagctggccttggaagcatccccatcatctatggcaccctgctgccggtgctctggaatgatccaaacaaccctcaaaaaacatggcatgagttcatgagccatggagaaaccctcctcaaccaaaccatctccaccgtggagaggaacagagctgctgcctacctggaaggctacaccaccgccgtcaagaaatgtgaagaagctctaaatgtttggctgacggcgccaaatcaagcaaatgcaaggaccgtcgccgacctctacaaggacaccgacttcctcttcttcaccacccttcctcatctgaagctgagagattttgaaaccctgctgctgagcagctacacccaagctgccaacatgcacctcatcctgctgaagcaagcaagcaaatatgctgatcaatggaatgctcagctgccagtttcagtgaggaaaacagcaaatgactactacacagatctggtgaagctgattggagaatacaccgactactgcattgccacctacaggagcggcctcaacaccatcaagagccgcgccaccagctggaacatctacaacatgtacaggagggagatgaccatcctggtgctggatctggtggcgctcttccctgcatatgacatcaagaaatatccatcaggcaccaaggtggagctgacaagggagatctacacagatgctctcggcgccgtcgccatcccccagaacattgatgcaacagagcagctggcaacaagagctccaaacctcttcagctggctgaagggcttcaagttcatcaccacccaaagcaccaacagatactacctctcagggatcgccaacagatacagcttcaccaacagcaatggagagatctggggccccatctctggaaatccaactggagtttcttctgatctcaccatcgacaacaacttctccatctacaagctgagcatcctccgcggctaccagctctcaccagatttctccttccacaaccctgttcatcaaattgatttcagcaccaccaacaaccagcaaggaagggtgcaaagctacaagagcggcggcccgacgccggtgaatccagaaaccaccgccatccacctccccatcgacagcaaatgcacccagaactgcaaccccaccttcaacaactacagccacatcctctcatatgctaaaaccttcaccagcaacctgaccattggaacaacaagcaacatcaccagctttggatggacccacaactcagtggacagggagaacaccatcgacctcaacaacatcacccagatccccgccgtcaaggccagccaagtttatccagagaacagcgtcatcaaggggcctggccacaccggcggcaacctggtgaggattgattcttctggctacatgagcatcgtctgcaagttccctctacaagtgaagggctacagggtgaggatcagatatgctgccaacaaccgcgccgagctctacatctcctctgctggaaattctccaagcaagaatgttgatcttgatccaaccttctccggcaccaactatgaaagcctcaactacaccaacttcaaggacaaggaaacagagttcatcatcacagaaggccagctggtgaagcagagcatcatcttctcaacaaatggaaatgtgctgctggacaagatcgagttcatccctcttggaacaacaacatatgaatatgaggagaagcagaacctggagaaggcgcagaaggcgctgaaggcgctcttcactgatggaacaaatggctacctccagatggatgcaacagattatgacatcaac

SEQ ID NO: 148 - DNA, 2067 bp, Artificial Sequence
  synthetic nucleotide sequence encoding toxin protein
atgaacagctatgagaacaagaatgaatatgagatcctggatgcttctcaaaacaacagcaacatgagcaacagatatcaaagatatcctcttgctcacaaccctcaaacatcaatccaaacaacaaactacaaggactggctcaagatgtgccaaaatcctcatcaaaatcctctggacatggaaggatatgacagcaacagcgtggtggtggtgagcaccggcctcatcgtggtgggcaccttgatctccatcctctcagctggccttggaagcatccccatcatctatggcaccttgctgccggtgctctggaatgatccaaacaaccctcaaaaaacatggcatgagttcatgagccatggagaaaccctcctcaaccaaaccatctccaccgtggagaggaacagagctgctgcctacctggaaggctacaccaccgccgtcaagaaatgtgaagaagctctaaatgtttggctgacggcgccaaatcaagcaaatgcaaggaccgtcgccgacctctacaaggacaccgacttcctcttcttcaccacccttcctcatctgaagctgagagattttgaaaccctgctgctgagcagctacacccaagctgccaacatgcacctcatcctgctgaagcaagcaagcaaatatgctgatcaatggaatgctcagcttcctgtttcagtgaggaaaacagcaaatgactactacacagatctggtgaagctgattggagaatacaccgactactgcattgccacctacaggagcggcctcaacaccatcaagagccgcgccaccagctggaacatctacaacatgtacagaagggagatgaccatcctggtgctggatctggtggcgctcttccctgcatatgacatcaagaaatatccatcaggcaccaaggtggagctgacaagggagatctacacagatgctcttggcgccgtcgccatccctcaaaacattgatgcaacagagcagctggcaacaagagctccaaacctcttcagctggctgaagggcttcaagttcatcaccacccaaagcaccaacagatactacctctcaggcattgccaacagatacagcttcaccaacagcaatggagagatctggggccccatctctggaaatccaactggagtttcttctgatctcaccatcgacaacaacttctccatctacaagctgagcatcctccgcggctaccagctctcaccagatttctccttccacaaccctgttcatcaaattgatttcagcaccaccaacaaccagcaaggaagagttcaaagctacaagagcggcggcccgacgccggtgaatccagaaacaacagccatccacctccccatcgacagcaaatgcacccagaactgcaaccccaccttcaacaactacagccacatcctctcatatgctaaaaccttcaccagcaacttgaccattggaacaacaagcaacatcaccagctttggatggacccacaattcagtggacagggagaacaccatcgacctcaacaacatcacccagatccccgccgtcaaggccagccaagtttatccagagaacagcgtcatcaaaggacctggccacaccggcggcaacctggtgaggattgattcttctggctacatgagcatcgtctgcaagttccctctacaagtgaagggctacagggtgaggatcagatatgctgccaacaaccgcgccgagctctacatctcctctgctggaaattctccaagcaagaatgttgatcttgatccaaccttctccggcaccaactatgaaagcctcaactacaccaacttcaaggacaaggaaacagagttcatcatcacagaaggccagctggtgaagcagagcatcatcttctcaacaaatggaaatgtgctgctggacaagatcgagttcatccctcttggaacaacaacatatgaatatgaagagaagcagaacctggagaaggcgcagaaggcgctgaaggcgctcttcactgatggaacaaatggctacctccagatggatgcaacagattatgacatcaac

SEQ ID NO: 149 - DNA, 2052 bp, Artificial Sequence
  synthetic nucleotide sequence encoding toxin protein
atgaaccagaacaacaacaatgaatatgagatcatcgacagcaagaacctcccctgcccaagcaacaggaacattgactacagccgccatcccttcaccaacaaccccaaccagccgctgcaaaacaccaactacaagaactggataaacatgtgccagaagaatcaacaatatggagaaaacctggagacatttgcttctgctgacaccattgctggagtttcagctggagtgattgtggtgggcaccatgctgggcgccttcgccgcgcccatcaccgccggcctcatcatcagcttcggcaccctgctgcccatcttctggaagcctggagaagatccaaaaacagtttggcaggccttcctcaagattggcaacaggcccttctcctcgccggtggatcaagctctcattgatctgctgagcaacaaggcaagatcattggagagccagttcaatgacttccaaagatattttgacatctggaacaacaacaagacgccaggaaatgctggagaggtgctgcgccgcttctcaagcctggatgctgacatcatcagggagctggagcagctgaagggcaactactacatcaccgtgctgccaggatatgctcaggtggccaactggcacctcaacctgctgaggatcgccgccttctactatgatcaatgggcatcaagcagcaacctctccatccagagcatctatccagaagattacatcaatgatcttcaaacctgcctcaccaactgcgccatcgagagcggcaacaagatcagcagcaagtactacaagtgcgtgctgaagtgccgcatcaatgagtacatcaactactgctcaaaaacatatcaagaaggcctcaacatcctcaagaacagcagcggcgtcaaatggaatgagtacaacacctacaggagggagatgaccatcaatgtgctggatctgatcgccgtgttccccaactatgatccagacaagtacctcatctcaacaaagagccagctgacaagggagatctacacagatgctctcatcgacgccttcgccaatgctcacttcaacatcaatgacatcgagaactcattgacaaggccgccggggctggtgacatggatcaacaggctggacttctacaccggcaagttccctggagatgttcctggcctcaccgccaacagcatcaactacagcttcaccaatggcaacagcaatgattctcccatctatggctacaggctctctggagattcaaggaaccccgtccagatccccctcaaccaatatgtctacaacatgctgatcacctacctctccaactctccttctgtcatccagaagatcgacttcaacctcaacaaccagcaaacaaggatctatgacaccggcctcaccctctcacccatctaccagagcaccatcaacctctcccttcctggcaaggacaggagcttccctccaaagttcaacaactacacccacttcctcagctatgtgaaaacagctcctggagatgaaaggccatcaagcagcagagcaagaaatgtttgctttggatggatgcacttctccgtcaatgattatgatgttcttgctggaggctacaacatcatcttcgacaccatcatcacccagatccccgccgtcaaggcgcggcatcttcctcttccttccttcgtgatgccaggacctggccacaccggcggcaacctggtggtgctctcaacccagattgagttccaatgcatcgtcctcaaccccgtcagctacaagatcaggatgagatatgttgcatattctccaaacagaagcatcaacctcaccgtcagcatcaggagcgagattggaaactaccagaacattgttccaaacataagcagcaccgtgcaatcaccagaggacaccaagaacccaaaatatgagcacttccagtacctggacatctccatcccgctggagctcttcggcatcaccaacatcaccatcacaaggagcgacagcatcagcaacaacaccctcatcatcgacaagatcgagttcaccccagatgtt

SEQ ID NO: 150 - DNA, 2052 bp, Artificial Sequence
  synthetic nucleotide sequence encoding toxin protein
atgaaccagaacaacaacaatgaatatgagatcatcgacagcaagaacctcccctgcccaagcaacaggaacattgactacagccgccatcccttcaccaacaaccccaaccagccgctgcaaaacaccaactacaagaactggataaacatgtgccagaagaatcaacaatatggagaaaacctggaaacatttgcttctgctgacaccattgctggagtttcagctggagtgattgtggtgggcaccatgctgggcgccttcgccgcgcccatcaccgccggcctcatcatcagcttcggcaccttgctgcccatcttctggaagcctggagaagatccaaaaacagtttggcaggccttcttgaagattggcaacaggcccttctcctcgccggtggatcaagctctcattgatctgctgagcaacaaggcaagatcattggagagccagttcaatgatttccaaagatattttgacatctggaacaacaacaagacaccaggaaatgctggagaggtgctgcgccgcttctcaagcctggatgctgacatcatcagggagctggagcagctgaagggcaactactacatcaccgtgctgccaggatatgctcaagtggccaactggcacctcaacctgctgaggatcgccgccttctactatgatcaatgggcatcaagcagcaacctctccatccagagcatctatccagaagattacatcaatgatcttcaaacctgcctcaccaactgcgccatcgagagcggcaacaagatcagcagcaagtactacaagtgcgtgctgaagtgccgcatcaatgaatacatcaactactgctcaaaaacatatcaagaaggcctcaacatcctcaagaacagcagcggcgtcaaatggaatgaatacaacacctacagaagggagatgaccatcaatgtgctggatctgatcgccgtgttccccaactatgatccagacaagtacctcatctcaacaaaaagccagctgacaagggagatctacacagatgctctcatcgacgccttcgccaatgctcacttcaacatcaatgacattgagaactcattgacaaggccgccggggctggtgacatggatcaacaggctggacttctacaccggcaagttccctggagatgttcctggcctcaccgccaacagcatcaactacagcttcaccaatggcaacagcaatgattctcccatctatggctacaggctctctggagattcaaggaaccctgttcagatccccctcaaccaatatgtctacaacatgctgatcacctacctctccaactctccttctgtcatccagaagatcgacttcaacctcaacaaccagcaaacaaggatctatgacaccggcctcaccctctcacccatctaccaaagcaccatcaacctctctcttcctggcaaggacaggagcttccctccaaagttcaacaactacacccacttcctcagctatgtgaaaacagctcctggagatgaaaggccatcaagcagcagagcaagaaatgtttgctttggatggatgcacttctccgtcaatgattatgatgttcttgctggaggctacaacatcatcttcgacaccatcatcacccagatccccgccgtcaaggcaaggcatcttcctcttccttccttcgtgatgccaggacctggccacaccggcggcaacctggtggtgctctcaacacaaattgagttccaatgcatcgtcctcaaccctgtcagctacaagatcaggatgagatatgttgcatattctccaaacagaagcatcaacctcaccgtcagcatcaggagcgagattggaaactaccagaacattgttccaaacataagcagcaccgtgcaatcaccagaggacaccaagaacccaaaatatgagcacttccagtacctggacatctccatcccgctggagctcttcggcatcaccaacatcaccatcacaaggagcgacagcatcagcaacaacaccttgatcatcgacaagatcgagttcactccagatgtt

SEQ ID NO: 151 - DNA, 2436 bp, Artificial Sequence
  synthetic nucleotide sequence encoding toxin protein
atggtgatcctcaatgacatctacaaggggccatacaatgtgctggcaaatcctcccatcatcctggacacagaaaatcctcaaaatccatgggacagctatgtcaactggaggcaggagctcaatgattcatgggcagaatatgatgaagatttcctgccgacgccggtgatgaagatcattgatgacattgcaaatgcatatgaaggaaagcctggaagctacctctccttggctcaagatggcatcaggttcgccttcctcttccttcctggaggccagagcgccgccttcgccatcaacaagatcctcggcctcatcttccccacccaccagccatcattgtttgatcagatcaaggatctggtggagcagatgattgatcagaagtttgagcagcaggagatcaacagcaacatcaacaggctcaatggcctcatcacccagctgggccagttctcaaacagcatccagcaagctcttggcaagcccatggacttccctgtgacccacctctcctccaccaccaacaagctctttgatgacaccaacatcttcgacaccaactatgattgcagcacagatccaaattgcagctgctcagaaacaccaaacagaagctctgatgcttctccctgcacgccgtgcccctgccgcatcaaaggagttcaagatgagttcattgcaacaaggaaggtgatcctggacatcctcaacaacatgaaaacatcactggatggcgtcctcaccaaggagcatgccaccacctacatgcaaatcttcctccccatctacaccaaggccgccaccctcctcttcggcatgtacaaatcatacattgagttcgccaccaagtacaacttcgagatgggagacaatggcaacaccatgaagtacaccaatgagctccgccagtacatcagcacagaaagcagctatgtctacaatgagttcaacaagtaccttcctgacagcaaggtgctgacaaaaggagatctcaacaagtacatccagtacagcaggaccatcaccctcaatgctctggacactgtttcaacatggccgctctacaacatcctggagtaccccatctccaccaccctcaacccaacaaggctggtgttcaatgacatcattgggccggtggaatgcaagaccaacaaccaaaattcagacagcttgagcttctccaccctctatgactacaccggcaacaacctcctcaacaatgacatcaccaactacttctacaagaacacccagctgcaaagcctgagcttccaaagatacaaatcaccaaagaacaaccccattgctcaagacatcatcgtcggcgtcagcgccaactactctgatggcatccagttcaagaaggaagcaagctggagcccctacaagggctacaccttggaatgggagaatgatgtgctgaaggactaccccaccctctccatcatgaatgctgtttcacttcaagacaatggaggcttcgtcgccattgatgaaagctggctgctgtacaacaacctctcctccgccagctgcgccagccagaacaacatcgtgttccccaaccagaagatccagagcatctcaaccctcacccccaacaacaccaagaagtacagcaactatggcaacaccgacaagctgggcctcatcaccaccttgatcccaaatgacacctcgccaagcatcatcctcaacaaccccatcggcatcaacaccttctccgccgagcaggccaccaccaccactggaacaaggctggtggaatatgtcaatggcgccgccgccctccagctgaagcaaggtcaatcagcagagtacatcatcaacacctccaccatcctctctggaaaatatcaagttcgcttccgcgccgccatgaatgatgctgacaatgcttgccacctctccttcaccatcaacaactcaacagaaactgtcaccctctccaaggacaccaacccgctgaagattgttggcaagcaaggaacctacatgatctcctcgccgacgagcttccagatcccctccaccaccaagctctccatgtcagtgctgaacaccggcgacaatgatgtcatcctggacaggatcgagttcatccccgccgtcatcaacaaggaccagatcaagattcctcctcaagatgtctacatccccttcaagggccacacgccgctctggaactcaaaggatgaaaggatcgtcacccatgccatcttcgagcagcctgttcaaagaagatatctccgcctctacctgaaggacaaatatgttgatctggtgccagatgatggcatcgtcaccacgccatttgattcaatcatcctctacaacagcacagagccttctgctgtcaacatccattttgaaggagcaaccctcaccctctcgccgcagaaccagaagcagttcaccaccttggag

SEQ ID NO: 152 - DNA, 2436 bp, Artificial Sequence
  synthetic nucleotide sequence encoding toxin protein
atggtgatcctcaatgacatctacaaggggccatacaatgtgctggcaaatcctcccatcatcctggacacagaaaatcctcaaaatccatgggacagctatgtcaactggaggcaggagctcaatgattcatgggcagaatatgatgaagatttcctgccgacgccggtgatgaagatcattgatgacattgcaaatgcatatgaaggaaaacctggaagctacctctccttggctcaagatggcatcagatttgccttcctcttccttcctggaggacaaagcgccgccttcgccatcaacaagatcctcggcctcatcttccccacccaccagccatcattgtttgatcagatcaaggatctggtggagcagatgattgatcaaaaatttgagcagcaggagatcaacagcaacatcaacaggctcaatggcctcatcacccagctgggccagttctcaaacagcatccagcaagctcttggcaagccaatggacttccctgtgacccacctctcctccaccaccaacaagctctttgatgacaccaacatcttcgacaccaactatgattgctcaacagatccaaattgcagctgctcagaaacaccaaacagaagctctgatgcttctccatgcacgccgtgcccctgccgcatcaaaggagttcaagatgagttcattgcaacaaggaaggtgatcctggacatcctcaacaacatgaaaacatcattggatggcgtcctcaccaaggagcatgccaccacctacatgcaaatcttcctccccatctacaccaaggccgccaccctcctcttcggcatgtacaaatcatacattgaatttgccaccaagtacaacttcgagatgggagacaatggcaacaccatgaagtacaccaatgagctccgccagtacatcagcacagaaagcagctatgtctacaatgagttcaacaagtaccttcctgacagcaaggtgctgacaaaaggagatctcaacaagtacatccagtacagcaggaccatcaccttgaatgctctggacactgtttcaacatggccgctctacaacatcctggagtaccccatctccaccaccttgaacccaacaaggctggtgttcaatgacatcattgggccggtggaatgcaagacaaacaaccaaaattcagattccttgagcttctccaccctctatgactacaccggcaacaacctcctcaacaatgacatcaccaactacttctacaagaacacccagctgcaaagcctgagcttccaaagatacaaatcaccaaagaacaaccccattgctcaagacatcatcgtcggcgtcagcgccaactactctgatggcatccagttcaagaaggaagcaagctggagcccctacaagggctacaccttggaatgggaaaatgatgtgctgaaggactaccccaccctctccatcatgaatgctgtttcacttcaagacaatggaggcttcgtcgccattgatgaaagctggctgctgtacaacaacctctcctccgccagctgcgccagccaaaacaacattgttttccccaaccagaagatccaaagcatctcaaccctcacccccaacaacaccaagaagtacagcaactatggcaacaccgacaagctgggcctcatcaccaccttgattccaaatgacacctctccaagcatcatcctcaacaaccccatcggcatcaacaccttctccgccgagcaggccaccaccaccactggaacaaggctggtggaatatgtcaatggcgccgccgccctccagctgaagcaaggtcaatcagcagagtacatcatcaacacctccaccatcctctctggaaaatatcaagttcgcttccgcgccgccatgaatgatgctgacaatgcttgccacctctccttcaccatcaacaactcaacagaaactgtcaccttgagcaaggacaccaacccgctgaagattgttggcaagcaaggaacctacatgatctcctcgccgacgagcttccagatcccctccaccaccaagctctccatgtcagtgctgaacaccggcgacaatgatgtcatcctggacaggattgagttcatccctgctgtcatcaacaaggatcagatcaagattcctcctcaagatgtctacatccccttcaagggccacacgccgctctggaactcaaaagatgaaaggatcgtcacccatgccatcttcgagcagcctgttcaaagaagatatctccgcctctacttgaaggacaaatatgttgatctggtgccagatgatggcatcgtcaccacgccatttgattcaatcatcctctacaacagcacagaaccttctgctgtcaacatccattttgaaggagcaaccctcaccctctcgccgcagaaccagaagcagttcaccaccttggag

SEQ ID NO: 153 - DNA, 2502 bp, Artificial Sequence
  synthetic nucleotide sequence encoding toxin protein
atgacaaacctctccgacctctactctgctgttccctacaacatcatggtgacgccgccgctgaaggagagctcatgggatgatttcaccgagttcatcaaggagctgaaaggaggatgggaggagtttgaaaaaactggctacagcaagccctacctcaacaccttggatgtggccatcaacctctacaagagcggcacccttgactacaccgcgctggccaagagcttcttgagcattggatcagctcttggagagttcatccctggaggagctgtggtggtgcccatcctctccggcctggtggacctcatcttccctcatctctttggaagcaagagctcaaacagccaaacagagttctttgatgccatcatcaaggaggttcagaagatgatcgacaaggagatccaagatttcaccaccagcttgctgcaagcaaacatccaaggatttgctgaagctgccaagctcttccagaaccagatccaatcagcaataggagctcctcatgctgtttttggccccaagctggatcaaggagcaacctgcaacacctcgccgtgcaagacgccgaccaaggaggacctcctcaccgtggagatgcagttcaccgccagcaacaccaccatggccagccaagttcctctcttcctgctgacgccaacaagctcagattctgacaccaacagagaaaccatcatgctcaccctccccatgttcgtcaccgccgccaccgtccacctgagcttgtaccaaggctacatccagttcatgcaaaaatggaacagcgtctatccagagatcgacatcgagagcaggatctccgagctgggagaatacatcgagagctactcaaagaaggcgctggacatctacaaccaatatgctccaacatatgacatcaacaacaaggatgtgctgaacaagtacatccagtacaacagggtgatgatcacccaggtgttcgacatggtgtcaatgtggccttccttcttccctcaagattatcctgccaagttcaagacagatcaaacaaggatcgccttcggcaacatagtggggccaacagaagatcagccaagcctccacttcgacctctatgatgtctacaagaaccagctaccaaacaatgacatcttcaactacttctacaatggcatgcagctggacaccttcgacctcttctctgatggagacaaccagaagctgaggaactacttcaccggcatcaagggctactacaagacctacaatgaaaatgtcatcacccaagatgatcctggaactggaaggcagaacattgctcacagcttctcctcagatgaggtgaagaacctcctcaacatcaacatgggcagcgtcaagacccagtacctggactacaacctcttctactacaactgcaagacaagcaaccctggaaaaacaccaagctacaccaccaatgattgcaaccagatcgacatcggcgccatcttcaactcaaaggacctccacctctccaacaacaccagctacagcaaccagaagctgcaagccatctacccggtgaggaaccccaagcaagtttggggaggaacaaacaaggctggcttcatctacaccttggtggattatgatctcttcccccagaacatcatcggcagcgccaacaaggatggatcattgaacaccaacatccaaggcttccctgctgaaaaaggaaccctcaacctcaccgccgagccgctcaccaaggtgctggagcccatcaactcagctgctgctgtcaacctcaagttccagcagatcctggcgctgcccatcaccaatgtcacagatcaaaactatgagatcagggtgagatatgcaagcaagagcgacatctccatcttcttccacatccaaactccttcagatgatctcaacagaggaaatcaaaccttgaagaacacagaaaatgccaccgacattgccatccaaggaaacaatggcatctacaccctccaaactcttgctgagaaggtttctcttccttctggcaacctcaccgtgttcatccagaacaacagcaactcagatctcttcctggacaggattgagttcatccctctctcccagacgccggacaccttcccgctgaccttcaaccctccagaaacaacaactcagccaaacaccaccaagaccatctggagcggcctcaagccggccaacaccttctccatccaaggaacagtttcaaatgatgtctccatcaccttccagctctacatgaatgacaacctggtgcaagagatccccgtcaaggggcctggccatggctacagcagcatggtgggctgcttggacaagagctcacccatcagccagccaaacatcgagaacaaggagttcaacaagctcatcctcaaggagctctctgacaaggctccagattgcttcaacagcaccttgagcaacacctacaaggtgaacatcaccatcgacaacaagagccagagcttcaccacgccggag

SEQ ID NO: 154 - DNA, 2502 bp, Artificial Sequence
  synthetic nucleotide sequence encoding toxin protein
atgacaaacctctcagatctctactctgctgttccatacaacatcatggtgacgccgccgctgaaggagagctcatgggatgatttcacagagttcatcaaggagctgaaaggaggatgggaggagtttgaaaaaactggctacagcaagccatacctcaacaccttggatgtggccatcaacctctacaagagcggcacccttgactacaccgcgctggccaagagcttcttgagcattggatcagctcttggagagttcatccctggaggagctgtggtggtgcccatcctctccggcctggtggacctcatcttccctcatctctttggaagcaagagctcaaacagccaaacagagttctttgatgccatcatcaaggaggttcagaagatgatcgacaaggagatccaagatttcaccaccagcttgctgcaagcaaacatccaaggatttgctgaagctgccaagctcttccagaaccagatccaatcagcaataggagctcctcatgctgtttttggccccaagctggatcaaggagcaacctgcaacacctcgccatgcaagacgccgaccaaggaggacctcctcaccgtggagatgcagttcaccgccagcaacaccaccatggcaagccaagttcctctcttcctgctgacaccaacaagctcagattctgacaccaacagagaaaccatcatgctcaccctccccatgttcgtcaccgccgccaccgtccacctgagcttgtaccaaggctacatccagttcatgcaaaaatggaacagcgtctatccagagatcgacattgaaagcaggatctcagagctgggagaatacattgaaagctattcaaagaaggcgctggacatctacaaccaatatgctccaacatatgacatcaacaacaaggatgtgctgaacaagtacatccagtacaacagggtgatgatcacccaggtgttcgacatggtgtcaatgtggccttccttcttccctcaagattatccagcaaagttcaagacagatcaaacaaggatcgccttcggcaacatagttggaccaacagaagatcaaccaagcctccacttcgacctctatgatgtctacaagaaccagctaccaaacaatgacatcttcaactacttctacaatggcatgcagctggacaccttcgacctcttctctgatggagacaaccagaagctgaggaactacttcaccggcatcaagggctactacaagacctacaatgaaaatgtcatcacccaagatgatcctggaactggaaggcagaacattgctcacagcttctcctcagatgaggtgaagaacctcctcaacatcaacatgggcagcgtcaagacccagtacctggactacaacctcttctactacaactgcaagacaagcaaccctggaaaaacaccaagctacaccaccaatgattgcaaccagatcgacatcggcgccatcttcaactcaaaggacctccacctctccaacaacaccagctacagcaaccagaagctgcaagccatctaccctgtgaggaaccccaagcaagtttggggaggaacaaacaaggctggcttcatctacaccttggtggattatgatctcttccctcaaaacatcatcggcagcgccaacaaggatggatcattgaacaccaacatccaaggcttccctgctgaaaaaggaaccctcaacctcaccgccgagccgctcaccaaggtgctggagcccatcaactcagctgctgctgtcaacctcaagttccagcagatcctggcgctgcccatcaccaatgtcacagatcaaaattatgagatcagggtgagatatgcaagcaagagcgacatctccatcttcttccacatccaaactccttcagatgatctcaacagaggaaatcaaacattgaagaacacagaaaatgcaacagacattgccatccaaggaaacaatggcatctacaccctccaaactcttgctgagaaggtttctcttccttctggaaacctcaccgtgttcatccagaacaacagcaattcagatctcttcctggacaggattgagttcatccctctctcccagacgccggacaccttcccgctgaccttcaaccctccagaaacaacaactcaaccaaacaccaccaagaccatctggagcggcctcaagccggccaacaccttctccatccaaggaacagtttcaaatgatgtctccatcaccttccagctctacatgaatgacaacctggtgcaagagatccctgtcaaaggacctggccatggctacagcagcatggtgggctgcttggacaagagctcacccatcagccagccaaacattgagaacaaggagttcaacaagctcatcctcaaggagctctctgacaaggctccagattgcttcaacagcaccttgagcaacacctacaaggtgaacatcaccatcgacaacaagagccagagcttcaccacgccggag

SEQ ID NO: 155 - DNA, 2577 bp, Artificial Sequence
  synthetic nucleotide sequence encoding toxin protein
atgaagaacaagaagaagtacatgaagcctcttgctgttgggctgctggccaccaacatcatcggcttcggcacccaaacagtggccttcgccgccaccgacaaggctggaagcaaggagcagatgcagcagcagatgaaaactcaaaacaagagcttcaaccccaccgtgctggcctccatgccatcagacacctctgagctccagaagatgctggaggatgccatcaagaacaaggacacccagatcacgccggagctcatcaagaagctgcaagacaaaggatttgactacctctccatcgtcaagggcctcactggagggctgctgaagcagattccatatgctggaagcatcctctcaccgctggtggtgggcctcttccctggaaaaggatatgtcaccaaggcaaatgtttggggagagatccaggacagggtttcaaacctcattgatcagaagctggaggagagccaggtgaacaacctcatcggcaagctcaccggcatccaggacaacctcggcatctaccaaacaagggtggggctggtgaatggcatcaagccgccgatcgccaacttcatccagaaggatgcaaattcagacaagaacaaggagaacttgaggagcaccattgacagcttggacaaggatcttggccgcgtcatcccagagttcgccgtcaaaggatatgaagctgcttctcttccatattatgttcaagtggcaaatgttcatctcttcctgctgaaggatgctctcacccatgctgatgaatgggggctgacagatgatgagaagagaggctacctctcaaggctccagcagaagatccaggagtacagctccgtggtgtatgacagcttcaacaaaggagtggaagctgcaaaatcaaaaggaggaagcactgctgacagctggaacaggacaaatgcatatgtgaggaccatgaccctctatggcctggattttgttgctctctggccggccttcgacaccaagcactacaaccagccggtgaagctccagcaaacaagggagctctactcaaacatgattggaaggcccatcaactggcaagattatgacaccaccctccagcagatccacaactctggatatgctggatatcctggagagctgaagcaggtgggcgtcagccaatgggacaggattgatggcatcagggagatcttcgactggacaggagatggaagcagggactacaccctccaatggggccatgccaacaagaatggatattcagacagaagccaaactgtcaacaaccccgccatcggcatctctgcatatgaaagcaacaatgccaacttctacaacatgagcaccatcacctacaagcagaacaatgaggtgagctggttctatggccccttcaccacccagagcgacagcaaggatggatcaaggatcgacagcaaggcgccggccggccacaagctcagcagggtgaaggtgcaagagaagagatcagatctcaacaccatcagcagcttcgtcgccgcctatgttccagaagaagttcatcctcaaaacatcctggaggccaaggccatcactggagttcctgctgaaaaatatcttgctcatgctggcttcgaggacaagatcgagtacatgaatggaagcaatgccatggtgagcagcaagaatggagacaccatcgactacaatgttcaatcaccagggaagcagaagtacaagatccgcctccgcgtcgccaccaacagtgacacctccgtcggcatctccatcaatggagattctcagcaggtgaacatcaagaacacagaagctgccaccaagctggaggatggcatcaccgtcaagggcgtcaatggcaagtacatgctgattgatggaccaacagtggagctctcagaaggcgtcaacaccattcagctgaagaacagcggcggcgccaagattgctctggacaggattgaatttgagcccattggaggagagctgaggaaatggaagcaagaaggagacaaatggtacttctatgatgaaaatgacaagaagctaacaggatggcagaagatcaatgaaaggaagtactacctcggccattctggagatggcagcggcatgacaacagaaggagagatggccaccggctggaaaaccattgatggagttcagtactacttcggccactcaggagatggcagcggcatggtgacagaaggagagatggccaccggctggaaaaccatcaatggcgtcaagtactacttcggccaaactggagatggatcagggatgcagcatgaaggagagaaggccaccggctggaaaaccattgatggagtgaagtactacttcaacaagacaggagatggcagcggcatgcagcatgaaggagagaaggccattggatggaaaaccattgatggcgtcaagtactacttcaacaagacaggagatggatcagggatgcagcatgaaggagagatggcgctgggagacatgaccattgatggcgtcaagcaccacttcaacaagacaggagatggaactggaagagatcatgaaggagagctggtgtgg

SEQ ID NO: 156 - DNA, 2577 bp, Artificial Sequence
  synthetic nucleotide sequence encoding toxin protein
atgaagaacaagaagaagtacatgaagcctcttgctgttgggctgctggccaccaacatcattggctttggcacccaaacagtggccttcgccgccaccgacaaggctggaagcaaggagcagatgcagcagcagatgaaaactcaaaacaagagcttcaaccccaccgtgctggcctccatgccatcagacacctctgagctccagaagatgctggaagatgccatcaagaacaaggacacccagatcacgccggagctcatcaagaagctgcaagacaaaggatttgactacctctccatcgtcaagggcctcactggagggctgctgaagcagattccatatgctggaagcatcctctcacctctggtggtgggcctcttccctggaaaaggatatgtcaccaaggcaaatgtttggggagagatccaggacagagtttcaaacttgattgatcagaagctggaggagagccaggtgaacaacctcatcggcaagctcaccggcatccaggacaaccttggcatctaccaaacaagggtggggctggtgaatggcatcaagccgccgatcgccaacttcatccagaaggatgcaaattcagacaagaacaaggagaacttgagaagcaccattgacagcttggacaaggatcttggaagggtcatcccagagtttgctgtcaaaggatatgaagctgcttctcttccatattatgttcaagttgcaaatgttcatctcttcctgctgaaggatgctctcacccatgctgatgaatgggggctgacagatgatgagaagagaggctacctctcaaggctccagcagaagatccaggagtacagctccgtggtgtatgacagcttcaacaaaggagtggaagctgcaaaatcaaaaggaggaagcactgctgacagctggaacagaacaaatgcatatgtgaggacaatgaccttgtatggcctggattttgttgctctctggccggccttcgacaccaagcactacaaccagccggtgaagctgcaacaaacaagggagctctactcaaacatgattggaaggcccatcaactggcaagattatgacaccaccttgcagcagatccacaattctggatatgctggatatcctggagagctgaagcaggtgggcgtcagccaatgggacaggattgatggcatcagggagatcttcgactggacaggagatggaagcagggactacaccttgcaatggggccatgcaaacaagaatggatattcagacagaagccaaactgtcaacaaccccgccatcggcatctctgcatatgaaagcaacaatgcaaacttctacaacatgagcaccatcacctacaagcagaacaatgaggtgagctggttctatggccccttcaccacccagagcgacagcaaggatggatcaaggatcgacagcaaggcgccggccggccacaagctctcaagggtgaaggttcaagaaaaaagatcagatctcaacaccatcagcagcttcgtcgccgcctatgttccagaagaagttcatcctcaaaacatcctggaggccaaggccatcactggagttcctgctgaaaaatatcttgctcatgctggatttgaggacaagattgagtacatgaatggaagcaatgccatggtgagcagcaagaatggagacaccatcgactacaatgttcaatcaccaggaaagcagaagtacaagatccgcctccgcgtcgccaccaacagtgacacctccgtcggcatctccatcaatggagattctcagcaggtgaacatcaagaacacagaagctgccaccaagctggaagatggcatcaccgtcaagggcgtcaatggcaagtacatgctgattgatggaccaacagtggagctctcagaaggcgtcaacaccattcagctgaagaacagcggcggcgccaagattgctctggacaggattgaatttgagccaattggaggagagctgaggaaatggaagcaagaaggagacaaatggtacttctatgatgaaaatgacaagaagctaacaggatggcagaagatcaatgaaaggaagtactacctcggccattctggagatggaagcggcatgacaacagaaggagagatggccactggatggaaaacaattgatggagttcagtactacttcggccactcaggagatggaagcggcatggtgacagaaggagagatggccactggatggaaaaccatcaatggcgtcaagtactacttcggccaaactggagatggatcagggatgcagcatgaaggagagaaggccactggatggaaaacaattgatggagtgaagtactacttcaacaaaactggagatggaagcggcatgcagcatgaaggagagaaggccattggatggaaaacaattgatggcgtcaagtactacttcaacaaaactggagatggatcagggatgcagcatgaaggagagatggcgctgggagacatgacaattgatggcgtcaagcaccacttcaacaaaactggagatggaactggaagagatcatgaaggagagctggtgtgg

SEQ ID NO: 157 - DNA, 2367 bp, Artificial Sequence
  synthetic nucleotide sequence encoding toxin protein
atgctggaggatgccatcaagaacaaggacacccagatcacgccggagctcatcaagaagctgcaagacaaaggatttgactacctctccatcgtcaagggcctcactggagggctgctgaagcagattccatatgctggaagcatcctctcaccgctggtggtgggcctcttccctggaaaaggatatgtcaccaaggcaaatgtttggggagagatccaggacagggtttcaaacctcattgatcagaagctggaggagagccaggtgaacaacctcatcggcaagctcaccggcatccaggacaacctcggcatctaccaaacaagggtggggctggtgaatggcatcaagccgccgatcgccaacttcatccagaaggatgcaaattcagacaagaacaaggagaacttgaggagcaccattgacagcttggacaaggatcttggccgcgtcatcccagagttcgccgtcaaaggatatgaagctgcttctcttccatattatgttcaagtggcaaatgttcatctcttcctgctgaaggatgctctcacccatgctgatgaatgggggctgacagatgatgagaagagaggctacctctcaaggctccagcagaagatccaggagtacagctccgtggtgtatgacagcttcaacaaaggagtggaagctgcaaaatcaaaaggaggaagcactgctgacagctggaacaggacaaatgcatatgtgaggaccatgaccctctatggcctggattttgttgctctctggccggccttcgacaccaagcactacaaccagccggtgaagctccagcaaacaagggagctctactcaaacatgattggaaggcccatcaactggcaagattatgacaccaccctccagcagatccacaactctggatatgctggatatcctggagagctgaagcaggtgggcgtcagccaatgggacaggattgatggcatcagggagatcttcgactggacaggagatggaagcagggactacaccctccaatggggccatgccaacaagaatggatattcagacagaagccaaactgtcaacaaccccgccatcggcatctctgcatatgaaagcaacaatgccaacttctacaacatgagcaccatcacctacaagcagaacaatgaggtgagctggttctatggccccttcaccacccagagcgacagcaaggatggatcaaggatcgacagcaaggcgccggccggccacaagctcagcagggtgaaggtgcaagagaagagatcagatctcaacaccatcagcagcttcgtcgccgcctatgttccagaagaagttcatcctcaaaacatcctggaggccaaggccatcactggagttcctgctgaaaaatatcttgctcatgctggcttcgaggacaagatcgagtacatgaatggaagcaatgccatggtgagcagcaagaatggagacaccatcgactacaatgttcaatcaccagggaagcagaagtacaagatccgcctccgcgtcgccaccaacagtgacacctccgtcggcatctccatcaatggagattctcagcaggtgaacatcaagaacacagaagctgccaccaagctggaggatggcatcaccgtcaagggcgtcaatggcaagtacatgctgattgatggaccaacagtggagctctcagaaggcgtcaacaccattcagctgaagaacagcggcggcgccaagattgctctggacaggattgaatttgagcccattggaggagagctgaggaaatggaagcaagaaggagacaaatggtacttctatgatgaaaatgacaagaagctaacaggatggcagaagatcaatgaaaggaagtactacctcggccattctggagatggcagcggcatgacaacagaaggagagatggccaccggctggaaaaccattgatggagttcagtactacttcggccactcaggagatggcagcggcatggtgacagaaggagagatggccaccggctggaaaaccatcaatggcgtcaagtactacttcggccaaactggagatggatcagggatgcagcatgaaggagagaaggccaccggctggaaaaccattgatggagtgaagtactacttcaacaagacaggagatggcagcggcatgcagcatgaaggagagaaggccattggatggaaaaccattgatggcgtcaagtactacttcaacaagacaggagatggatcagggatgcagcatgaaggagagatggcgctgggagacatgaccattgatggcgtcaagcaccacttcaacaagacaggagatggaactggaagagatcatgaaggagagctggtgtgg

SEQ ID NO: 158 - DNA, 2367 bp, Artificial Sequence
  synthetic nucleotide sequence encoding toxin protein
atgctggaagatgccatcaagaacaaggacacccagatcacgccggagctcatcaagaagctgcaagacaaaggatttgactacctctccatcgtcaagggcctcactggagggctgctgaagcagattccatatgctggaagcatcctctcacctctggtggtgggcctcttccctggaaaaggatatgtcaccaaggcaaatgtttggggagagatccaggacagagtttcaaacctcattgatcagaagctggaggagagccaggtgaacaacctcatcggcaagctcaccggcatccaggacaacctcggcatctaccaaacaagggtggggctggtgaatggcatcaagccgccgatcgccaacttcatccagaaggatgcaaattcagacaagaacaaggagaacttgagaagcaccattgacagcttggacaaggatcttggaagggtcatcccagagttcgccgtcaaaggatatgaagctgcttctcttccatattatgttcaagttgcaaatgttcatctcttcctgctgaaggatgctctcacccatgctgatgaatgggggctgacagatgatgagaagagaggctacctctcaaggctccagcagaagatccaggagtacagctccgtggtgtatgacagcttcaacaaaggagtggaagctgcaaaatcaaaaggaggaagcactgctgacagctggaacagaacaaatgcatatgtgaggacaatgaccttgtatggcctggattttgttgctctctggccggccttcgacaccaagcactacaaccagccggtgaagctgcaacaaacaagggagctctactcaaacatgattggaaggcccatcaactggcaagattatgacaccaccttgcagcagatccacaactctggatatgctggatatcctggagagctgaagcaggtgggcgtcagccaatgggacaggattgatggcatcagggagatcttcgactggacaggagatggaagcagggactacaccttgcaatggggccatgcaaacaagaatggatattcagacagaagccaaactgtcaacaaccccgccatcggcatctctgcatatgaaagcaacaatgcaaacttctacaacatgagcaccatcacctacaagcagaacaatgaggtgagctggttctatggccccttcaccacccagagcgacagcaaggatggatcaaggatcgacagcaaggcgccggccggccacaagctctcaagggtgaaggtgcaagaaaaaagatcagatctcaacaccatcagcagcttcgtcgccgcctatgttccagaagaagttcatcctcaaaacatcctggaggccaaggccatcactggagttcctgctgaaaaatatcttgctcatgctggcttcgaggacaagattgagtacatgaatggaagcaatgccatggtgagcagcaagaatggagacaccatcgactacaatgttcaatcaccaggaaagcagaagtacaagatccgcctccgcgtcgccaccaacagtgacacctccgtcggcatctccatcaatggagattctcagcaggtgaacatcaagaacacagaagctgccaccaagctggaagatggcatcaccgtcaagggcgtcaatggcaagtacatgctgattgatggaccaacagtggagctctcagaaggcgtcaacaccattcagctgaagaacagcggcggcgccaagattgctctggacaggattgaatttgagccaattggaggagagctgaggaaatggaagcaagaaggagacaaatggtacttctatgatgaaaatgacaagaagctaacaggatggcagaagatcaatgaaaggaagtactacctcggccattctggagatggaagcggcatgacaacagaaggagagatggccactggatggaaaacaattgatggagttcagtactacttcggccactcaggagatggaagcggcatggtgacagaaggagagatggccactggatggaaaaccatcaatggcgtcaagtactacttcggccaaactggagatggatcagggatgcagcatgaaggagagaaggccactggatggaaaacaattgatggagtgaagtactacttcaacaaaactggagatggaagcggcatgcagcatgaaggagagaaggccattggatggaaaacaattgatggcgtcaagtactacttcaacaaaactggagatggatcagggatgcagcatgaaggagagatggcgctgggagacatgacaattgatggcgtcaagcaccacttcaacaaaactggagatggaactggaagagatcatgaaggagagctggtgtgg

SEQ ID NO: 159 - DNA, 2280 bp, Artificial Sequence
  synthetic nucleotide sequence encoding toxin protein
atggaagaatgtggaagatacatggcaaatgagaacagcaccaacaaccctgacaccaacaacaaccccatctacaatgagaaccaaaatgagaactatggagacaccaatggctacagctcagaacctggagtgaatgacaccaatgtctacagcaatgacacctctggatatgcaaatgacaccaatgccaacaccggcgactacaacaccggcaccatcaacagctcagagatgaacaatgacacctacaactctggaaatgtcaactacctggtggagaaccctgggctgctggaggaggttcctcaagttccctacaatgtggtggccaagccgctctacctccaaacagatgaagaaacagaagaagcatggaggatctgggagagcagagatccaagcatcttcatcccggcgctggtgggcatcattggatcaatgctgctgaagaaggtggccggcctcatcatcgaccgcgcgctgaagaagctctatggctacctcttccctggtgatgctcccatcaccatgctggacatcctccgcgccgtggaggagctggtgaaccagaggatcgaggtggccgtccgccagctggtggaagcagagctagaaggcctccagcgcgccgtcaagagctttgaagatgatgtggccaccttcgagagctctcaatctccttccttcatggaggagatcaccaaggtgatccaaacagaagaagccatcagaactggagaagagctgccgacgccgacggccatcattgattcagtgaacaggctcaatgcaacatttgctcaagccatccccaagttccgccttccagattggaagaaccagagcttgccgctctatgctcaagctgccaacctccacctcttcttcttgagagatgtcatcgacaatgctcaaaaatggggcctcaccacctcagagatcaacagatacaagaatgatctgaagaactacatccaggagtacagcaactactgcatctccacctacaaggcagaatttgatcgccgcttccagaacacaagatttgacaaggcgctggagttcagaaacttcatgaccctcaatgtgctggattatgttggcatctggtcaatgctgcgctacagcaatgtggtgatcaacagcagcatgaacctctacaacaccacctgccgcctggcgctgccgctggcatcatggaactacctcaatgccatgatgcaaggaaggccaaataagatcctgctggcgctgggaactggaaggctggagacatatcatcctctcatccctgggccgacgccaggaagcattgccatccctgctgaaacaagcaacagatacttctacaccggcacccactacatcaatggcaacagcaccggcaccgtcggcctgattcctcttccagattcaccaggaagcctcttcaccaaatgggagaagagcatccccgccttctatgtcacagatcctgtccgctcgccatggatcgtcgccaacctgacaaggaccatcaccagcagcagcagagaaagggtggacaatgaaagcatcaggttctcctcaagaagaggagatcctggaacacaatatccagattactacatcagaaatgtcaccggcctccccaacaggctctcagatccatatcctgacattgtgaatggcttctggaacaagaaaacaacaacagctcagatcggcgtcaccgccaccttcaacaggaccatcatctcagctcacaccaacaatggaagcatcaagcacatagttccatatgttgctgatgaaacaaacctcgccgtccccaagccaagaggcttcaccatccttcctctccagcatgattgggcctacaatggagatggaagcaacaacctcctccgcttctcagagaagtttggcaacaatggagatgccatctccatcccaacagctgctggaggaagcaagcatgtgaggttcaactacaagatcgacaacactggaagcacagatgtcagctatgatgtctacctgaaggtggccaccgtcggcgccggcaccaccaacttcttcgtcgccaagaatggaactggatatggcaagaacatctccaccgccacctcaaatgatggcatcaccgacaatggcgtcaagttcaaggacatcctcatctaccccaacatctccatccccaagaacacccaggtgacgctggagatcaccgtcagcggcagcgccgcctacctcggccagatcatcttcgtgccgcgcggcgtcacccccatctac

SEQ ID NO: 160 - DNA, 2280 bp, Artificial Sequence
  synthetic nucleotide sequence encoding toxin protein
atggaagaatgtggaagatacatggcaaatgaaaacagcaccaacaatccagacaccaacaacaaccccatctacaatgaaaatcaaaatgaaaattatggagacacaaatggctacagctcagaacctggagtgaatgacacaaatgtctacagcaatgacacttctggatatgcaaatgacacaaatgcaaacactggagactacaacactggcaccatcaacagctcagagatgaacaatgacacctacaattctggaaatgtcaactacctggtggagaatcctgggctgctggaagaagttcctcaagttccatacaatgtggtggccaagcctctctacctccaaacagatgaagaaacagaagaagcatggaggatctgggagagcagagatccaagcatcttcatcccggcgctggtgggcatcattggatcaatgctgctgaagaaggtggctggcctcatcatcgaccgcgcgctgaagaagctctatggctacctcttccctggtgatgctcccatcaccatgctggacatcctccgcgccgtggaggagctggtgaaccaaaggattgaggtggccgtccgccagctggtggaagcagagctagaaggcctccagcgcgccgtcaagagctttgaagatgatgttgccacctttgaaagctctcaatctccttccttcatggaggagatcaccaaggtgatccaaacagaagaagccatcagaactggagaagagctgccgacgccgacggccatcattgattcagtgaacaggctcaatgcaacatttgctcaagccatccccaagttccgccttccagattggaagaaccagagcttgcctctctatgctcaagctgcaaacctccatctcttcttcttgagagatgtcatcgacaatgctcaaaaatggggcctcaccacctcagagatcaacagatacaagaatgatctgaagaactacatccaggagtacagcaactactgcatctccacctacaaggcagaatttgatcgccgcttccagaacacaagatttgacaaggcgctggagttcagaaacttcatgaccttgaatgtgctggattatgttggcatctggtcaatgctgagatacagcaatgttgtcatcaacagcagcatgaacctctacaacaccacctgccgcctggcgctgccgctggcatcatggaactacctcaatgcaatgatgcaaggaaggccaaataagatcctgctggctcttggaactggaaggctggaaacatatcatcctctcatccctgggccaacaccaggaagcattgccatccctgctgaaacaagcaacagatatttctacactggaacccactacatcaatggaaacagcactggcaccgtcggcctgattcctcttccagattcaccaggaagcctcttcaccaaatgggagaagagcatccccgccttctatgtcacagatcctgttcgctctccatggatcgtcgccaacttgacaagaaccatcaccagcagcagcagagaaagggtggacaatgaaagcatcaggttctcctcaagaagaggagatcctggaacacaatatccagattactacatcagaaatgtcaccggcctccccaacaggctctcagatccatatcctgacattgtgaatggcttctggaacaagaaaacaacaacagctcagatcggcgtcaccgccaccttcaacagaaccatcatctcagctcacaccaacaatggaagcatcaagcacatagttccatatgttgctgatgaaacaaacctcgccgtgccaaagccaagaggcttcaccatccttcctcttcagcatgattgggcctacaatggagatggaagcaacaacctcctccgcttctcagaaaaatttggaaacaatggagatgccatctccatcccaacagctgctggaggaagcaagcatgtgaggttcaactacaagattgacaacactggaagcacagatgtcagctatgatgtctacttgaaggtggccaccgtcggcgccggcaccaccaacttcttcgtcgccaagaatggaactggatatggaaagaacatctccaccgccacctcaaatgatggcatcaccgacaatggcgtcaagttcaaggacatcctcatctaccccaacatctccatccccaagaacacccaggtgaccttggagatcaccgtcagcggcagcgccgcctaccttggccagatcatcttcgtgccgcgcggcgtcacccccatctac

SEQ ID NO: 161 - DNA, 2046 bp, Artificial Sequence
  synthetic nucleotide sequence encoding toxin protein
atgaacaatgacacctacaactctggaaatgtcaactacctggtggagaaccctgggctgctggaggaggttcctcaagttccctacaatgtggtggccaagccgctctacctccaaacagatgaagaaacagaagaagcatggaggatctgggagagcagagatccaagcatcttcatcccggcgctggtgggcatcattggatcaatgctgctgaagaaggtggccggcctcatcatcgaccgcgcgctgaagaagctctatggctacctcttccctggtgatgctcccatcaccatgctggacatcctccgcgccgtggaggagctggtgaaccagaggatcgaggtggccgtccgccagctggtggaagcagagctagaaggcctccagcgcgccgtcaagagctttgaagatgatgtggccaccttcgagagctctcaatctccttccttcatggaggagatcaccaaggtgatccaaacagaagaagccatcagaactggagaagagctgccgacgccgacggccatcattgattcagtgaacaggctcaatgcaacatttgctcaagccatccccaagttccgccttccagattggaagaaccagagcttgccgctctatgctcaagctgccaacctccacctcttcttcttgagagatgtcatcgacaatgctcaaaaatggggcctcaccacctcagagatcaacagatacaagaatgatctgaagaactacatccaggagtacagcaactactgcatctccacctacaaggcagaatttgatcgccgcttccagaacacaagatttgacaaggcgctggagttcagaaacttcatgaccctcaatgtgctggattatgttggcatctggtcaatgctgcgctacagcaatgtggtgatcaacagcagcatgaacctctacaacaccacctgccgcctggcgctgccgctggcatcatggaactacctcaatgccatgatgcaaggaaggccaaataagatcctgctggcgctgggaactggaaggctggagacatatcatcctctcatccctgggccgacgccaggaagcattgccatccctgctgaaacaagcaacagatacttctacaccggcacccactacatcaatggcaacagcaccggcaccgtcggcctgattcctcttccagattcaccaggaagcctcttcaccaaatgggagaagagcatccccgccttctatgtcacagatcctgtcagatctccatggatcgtcgccaacctgacaaggaccatcaccagcagcagcagagaaagggtggacaatgaaagcatcaggttctcctcaagaagaggagatcctggaacacaatatccagattactacatcagaaatgtcaccggcctccccaacaggctctcagatccatatcctgacattgtgaatggcttctggaacaagaaaacaacaacagctcagatcggcgtcaccgccaccttcaacaggaccatcatctcagctcacaccaacaatggaagcatcaagcacatagttccatatgttgctgatgaaacaaacctcgccgtccccaagccaagaggcttcaccatccttcctctccagcatgattgggcctacaatggagatggaagcaacaacctcctccgcttctcagagaagtttggcaacaatggagatgccatctccatcccaacagctgctggaggaagcaagcatgtgaggttcaactacaagatcgacaacactggaagcacagatgtcagctatgatgtctacctgaaggtggccaccgtcggcgccggcaccaccaacttcttcgtcgccaagaatggaactggatatggcaagaacatctccaccgccacctcaaatgatggcatcaccgacaatggcgtcaagttcaaggacatcctcatctaccccaacatctccatccccaagaacacccaggtgacgctggagatcaccgtcagcggcagcgccgcctacctcggccagatcatcttcgtgccgcgcggcgtcacccccatctac

SEQ ID NO: 162 - DNA, 2046 bp, Artificial Sequence
  synthetic nucleotide sequence encoding toxin protein
atgaacaatgacacctacaattctggaaatgtcaactacttggtggaaaatcctgggctgctggaagaagttcctcaagttccatacaatgtggtggccaagcctctctacctccaaacagatgaagaaacagaagaagcatggaggatctgggaaagcagagatccaagcatcttcatcccggcgctggtgggcatcattggatcaatgctgctgaagaaggttgctggcctcatcatcgaccgcgcgctgaagaagctctatggctacctcttccctggtgatgctcccatcaccatgctggacatcctccgcgccgtggaggagctggtgaaccaaaggattgaggtggccgtccgccagctggtggaagcagagctagaaggcctccagcgcgccgtcaagagctttgaagatgatgttgccacctttgaaagctctcaatctccttccttcatggaggagatcaccaaggtgatccaaacagaagaagccatcagaactggagaagagctgccgacgccgacggccatcattgattcagtgaacaggctcaatgcaacatttgctcaagccatccccaagttccgccttccagattggaagaaccagagcttgcctctctatgctcaagctgcaaacctccatctcttcttcttgagagatgtcatcgacaatgctcaaaaatggggcctcaccacctcagagatcaacagatacaaaaatgatctgaagaactacatccaagaatacagcaactactgcatctccacctacaaagcagaatttgatcgccgcttccaaaacacaagatttgacaaggcgctggagttcagaaacttcatgacattgaatgtgctggattatgttggcatctggtcaatgctgagatacagcaatgttgtcatcaacagcagcatgaacctctacaacaccacctgccgcctggcgctgccgctggcatcatggaactacctcaatgcaatgatgcaaggaaggccaaataagatcctgctggctcttggaactggaaggctggaaacatatcatcctctcatccctgggccaacaccaggaagcattgccatccctgctgaaacaagcaacagatatttctacactggaacccactacatcaatggaaacagcactggcaccgtcggcttgattcctcttccagattcaccaggaagcctcttcaccaaatgggagaagagcatccctgccttctatgtcacagatcctgtcagatctccatggatcgtcgccaacttgacaagaaccatcaccagcagcagcagagaaagggtggacaatgaaagcatcagattctcttcaagaagaggagatcctggaacacaatatccagattactacatcagaaatgtcaccggcctccccaacaggctctcagatccatatcctgacattgtgaatggcttctggaacaagaaaacaacaacagctcagatcggcgtcaccgccaccttcaacagaaccatcatctcagctcacaccaacaatggaagcatcaagcacatagttccatatgttgctgatgaaacaaacctcgccgtgccaaagccaagaggcttcaccatccttcctcttcaacatgattgggcctacaatggagatggaagcaacaacctcctccgcttctcagaaaaatttggaaacaatggagatgccatctccatcccaacagctgctggaggaagcaagcatgtgaggttcaactacaagattgacaacactggaagcacagatgtttcatatgatgtctacttgaaggtggccaccgtcggcgccggcaccaccaacttcttcgtcgccaaaaatggaactggatatggaaagaacatctccaccgccacctcaaatgatggcatcaccgacaatggtgtcaagttcaaggacatcctcatctaccccaacatctccatccccaagaacacccaggtgaccttggagatcaccgtcagcggcagcgccgcctaccttggccagatcatcttcgtgccgcgcggcgtcacccccatctac

SEQ ID NO: 163 - DNA, 3153 bp, Artificial Sequence
  synthetic nucleotide sequence encoding toxin protein
atgcaccagaacaggaacatccgcggcggcctctacatgaactacaacaacaatgaatatgagatcctggacaatggcaacattggctaccagccaagatatcctctggtgaactctcctggagcagagttccagcagatgaactacactgattggatgaacagatgcaactatggagaatcaggagaggtgttctcctctgcaagagatggcgtcatcattgccaccggcattggatgggccatccttggcttcatccccgtcatcggccctggcctctccgccgccgccggcgtcctcaatgtcatcctcagctacctctggcctgaagatgctggagctcctggaacagaagttgctcagatctcatggaacaggatcttgaggacggtggaaggcctcatcgacaccgcgctctcctccgtcatcaagacggtggcaacaacagagctgagagatctccaggaggacatcatctcatacaacctggcgctctgcaacctcaagacagatccaaacaatgaaacatacaagacaacagtgagaagagaatttgacaatgctgctgatcaagcaagaaaaaccatcctcgccatgtcacccatcaccccagatcaaccagcagaaacaaagaagaatgccatcctgctgctggcagattatgctcaagctgccaacctccacctgctgctgctgagagatgtcatccaatatggagaaagctggggcttctcaccgctggaggtgcagcagtactatgacaacccttctggaagatctgggatgaagcagaggctggaggagtacaccaactactgcgtcaactggtacaatgttgctctctccgacatcagagcatcaggcgtctacttcgacaacaaatggaggcagttcaatgccttcagaagggacatgaccatcatggtgctggacatcgtcagcctctggccaacatttgatccaaggctctaccctgtttcaacaaagagccagctgacaaggacggtgtacacagatcccatcggcattggaagcagcagcggcatcgacttcaccaccgtgccatttgatctggtggagagcagcatcgtcgccgcgcccaagctcttctcatggctgaggaagcaggagttctccttcaaggactgggctgatgtctaccccattgctggctacaagatgaccttccagaacaccctctccgccgcgctctgggaaggcagcttcattggaacaagagatctgagctatgtggtggagaagcaaaccctcaccatcccagatcctcagctcaatgatgacatctggcagattggaacaaattcagattctgttcgaggaacagtttatggctggtacttccccttcacccaatctccagatcagtacattggctctccagatctggacaggaagatcttgagcggcctcccctgcaagggcaacaacccctccatctgcgcgccgtgccaatcagagaacagctgcaatggagggccgctcaacaccaccaacccctgcaatgacaagcagatgtacagccaccgcttctcatacatgggagctggagcaagggagctggcggcgccctacaacagcttgaccttctttggatatggatggacccacatctctgctgatccaaacaacctcattgatgctgagaagatcactcagatccccgccgtcaaggcctcctccatctctggagatgcaagggtggtgcgcggccctggaagcactggaggagatctggtgaagttctcagctccaagcaacaccttcaccaacatcggcctctggaccaccatccctgctggcatccgcgcctacagggtgaggatcagatatgcaagcaatgctgacatcccgctggatgtgctgatctcaagaactggatatggcaccttcattgctccagcaacaacaacagatctcaacaacctcgcctacaacaagtttggctacctggacaccttggtgttcatgtcagatgagccaaatgagcaatatgagcaggacatcaacttctccctcaaccaggtggcagattctggcaccttgatcctggacaagatcgagttcatccccatggaggagagcttggaagaatatgaagcaaatcaagctctggagaaggcaaggaaggccgtcaatgctctgctgatctcagatgccaaggatgctctgaagctcaacatcacagattatgctgttgatcaagctgccaacctggcagaatgtgtttcagaagatttccatgctcaagagaagatgatcctgctggaccaggtgaagttcgccaagaggctcagccatgcaaggaacctgctgaactatggagattttgaaagctcagattggagtggagaaaatggatggaggacaagccaccatgtttctgtgaggagcgacaaccccatcttcaaaggaagatatctccacatccctggagcaacaagcagccagttcagcagccatgtctaccccacctacatctaccagaaggtggatgaatcaaagctgaagagctacacaagatatctggtgcgcggcttcatcggcaacagcaaggatctggagctgctggtggagagatatggcaaggatgttcatgtggagatggatgttccaaatgacatccagtacaccctccccatgaatgaatgtggaggcttcgaccgctgcaagccagcttcagatcaagcaaggctcagccacacctgcacctgcaatgacaccgccgtcacccacacagattgccaatgcaaggacaagggcaacaggacaagcaccaacatgtacaccaatgttccaacaggatcagctgtctacagaaatggaagccatgatcacaagagctgcggctgcaagaacaatgacatgtaccagaacaggacccatcctcacaagagctgcggctgcaaagatcctcatgttttcacctaccacatcgacactggatgtgttgatcaagaagaaaacctcggcctctggtttgctctgaagattgcttcagaaaatggcgtcgccaacatcgacaacctggagatcattgaagctcagccgctcactggagaagctctggcaagggtgaagaagagggagcagaaatggaagaaggaggtggccaagaagaggctggagacagaa

SEQ ID NO: 164 - DNA, 3153 bp, Artificial Sequence
  synthetic nucleotide sequence encoding toxin protein
atgcatcaaaacaggaacatccgcggcggcctctacatgaactacaacaacaatgaatatgagatcctggacaatggaaacattggctaccagccaagatatcctctggtgaactctcctggagcagagttccagcagatgaactacactgattggatgaacagatgcaactatggagaatcaggagaagttttctcttctgcaagagatggcgtcatcattgcaactggcattggatgggccatccttggcttcatccctgtcattggacctggcctctccgccgccgccggcgtcctcaatgtcatcctcagctacctctggcctgaagatgctggagctcctggaacagaagttgctcagatctcatggaacaggatcttgaggacggtggaaggcctcatcgacaccgcgctctcctccgtcatcaagacagtggcaacaacagagctgagagatcttcaagaggacatcatctcatacaacctggcgctctgcaacctcaagacagatccaaacaatgaaacatacaaaacaacagtgagaagagaatttgacaatgctgctgatcaagcaagaaaaaccatcctcgccatgtcacccatcactccagatcaaccagcagaaacaaagaagaatgccatcctgctgctggcagattatgctcaagctgcaaacctccatctgctgctgctgagagatgtcatccaatatggagaaagctggggcttctcacctctggaggtgcagcagtactatgacaacccttctggaagatctgggatgaagcagaggctggaggagtacaccaactactgcgtcaactggtacaatgttgctctctccgacatcagagcatcaggcgtctacttcgacaacaaatggaggcagttcaatgccttcagaagagacatgaccatcatggtgctggacatcgtcagcctctggccaacatttgatccaaggctctatcctgtttcaacaaaaagccagctgacaaggacggtgtacacagatcccatcggcattggaagcagcagcggcatcgacttcaccaccgtgccatttgatctggtggagagcagcatcgtcgccgcgccaaagctcttctcatggctgaggaagcaggagttctccttcaaggactgggctgatgtctaccccattgctggctacaagatgaccttccagaacaccctctccgccgcgctctgggaaggcagcttcattggaacaagagatctgagctatgtggtggagaagcaaaccctcaccatcccagatcctcagctcaatgatgacatctggcagattggaacaaattcagattctgttcgaggaacagtttatggatggtacttccccttcacccaatctccagatcagtacattggatctccagatctggacaggaagatcttgagcggcctcccctgcaaaggaaacaacccaagcatctgcgcgccatgccaatcagaaaacagctgcaatggagggccgctcaacaccaccaacccctgcaatgacaagcagatgtacagccaccgcttctcatacatgggagctggagcaagggagctggcggcgccctacaacagcttgaccttctttggatatggatggacccacatctctgctgatccaaacaacctcattgatgctgagaagatcactcagatccctgctgtcaaggcctcctccatctctggagatgcaagggtggtgcgcggccctggaagcactggaggagatctggtgaagttctcagctccaagcaacaccttcaccaacattggcctctggaccaccatccctgctggcatccgcgcctacagggtgaggatcagatatgcttcaaatgctgacatccctcttgatgtgctgatctcaagaactggatatggcaccttcattgctccagcaacaacaacagatctcaacaacctcgcctacaacaagtttggctacctggacaccttggtgttcatgtcagatgaaccaaatgaacaatatgagcaggacatcaacttctccttgaaccaggtggcagattctggaacattgatcctggacaagattgagttcatccccatggaggagagcttggaagaatatgaagcaaatcaagctctggagaaggcaaggaaggctgtcaatgctctgctgatctcagatgccaaggatgctctgaagctcaacatcacagattatgctgttgatcaagctgcaaaccttgctgaatgtgtttcagaagatttccatgctcaagagaagatgatcctgctggatcaagtgaagttcgccaagaggctcagccatgcaaggaacctgctgaactatggagattttgaaagctcagattggagtggagaaaatggatggaggacaagccatcatgtttctgtgaggagcgacaaccccatcttcaaaggaagatatctccacatccctggagcaacaagcagccagttcagcagccatgtctaccccacctacatctaccagaaggtggatgaatcaaagctgaagagctacacaagatatttggtgagaggcttcatcggcaacagcaaggatctggagctgctggtggaaagatatggcaaggatgttcatgtggagatggatgttccaaatgacatccagtacaccctccccatgaatgaatgtggaggcttcgacagatgcaagccagcttcagatcaagcaaggctcagccacacctgcacctgcaatgacaccgccgtcacccacacagattgccaatgcaaggacaaaggaaacagaacaagcaccaacatgtacaccaatgttccaacaggatcagctgtctacagaaatggaagccatgatcacaagagctgcggctgcaagaacaatgacatgtaccagaacagaacacatcctcacaagagctgcggctgcaaagatcctcatgttttcacctaccacatcgacactggatgtgttgatcaagaagaaaatcttggcctctggtttgctctgaagattgcttcagaaaatggcgtcgccaacatcgacaacctggagatcattgaagctcagcctctcactggagaagctcttgcaagggtgaagaagagggagcaaaaatggaagaaggaggtggccaagaagaggctggaaacagaa

SEQ ID NO: 165 - DNA, 1956 bp, Artificial Sequence
  synthetic nucleotide sequence encoding toxin protein
atgaactacacagattggatgaacagatgcaactatggagaaagtggagaggtgttctcctcagcaagagatggcgtcatcattgccaccggcattggatgggccatcctcggcttcatccccgtcatcggccctggcctctccgccgccgccggcgtcctcaatgtcatcctcagctacctctggcctgaagatgctggagctcctggaacagaggtggcgcagatctcatggaacaggatcttgaggacggtggaaggcctcatcgacaccgcgctctcctcagtcatcaagacggtggcaacaacagagctgagagatcttcaagaggacatcatcagctacaacctggcgctctgcaacctcaagacagatccaaacaatgaaacatacaagacaacagtgagaagagaatttgacaatgctgctgatcaagcaagaaaaaccatcctcgccatgtcacccatcaccccagatcaaccagcagaaacaaagaagaatgccatcctgctgctggcagattatgctcaagctgccaacctccacctgctgctgctgagagatgtcatccaatatggagaaagctggggcttctcgccgctggaggtgcagcagtactatgacaacccatcaggaagaagcggcatgaagcagaggctggaggagtacaccaactactgcgtcaactggtacaatgttgctctctccgacatccgcgcctcaggcgtctacttcgacaacaaatggaggcagttcaatgccttcagaagggacatgaccatcatggtgctggacatcgtcagcctctggccaacatttgatccaaggctctaccctgtctccaccaagagccagctgacaaggacggtgtacacagatcccatcggcattggaagcagctcaggcatcgacttcaccaccgtgcccttcgacctggtggagagcagcatcgtcgccgcgcccaagctcttcagctggctgaggaagcaggagttctccttcaaggactgggctgatgtctaccccattgctggctacaagatgaccttccagaacaccctctcagctgctctctgggaaggcagcttcattggaacaagagatctgagctatgtggtggagaagcaaaccctcaccatcccagatcctcagctcaatgatgacatctggcagattggcaccaacagcgacagcgtcagaggaacagtttatggctggtacttccccttcacccaatctccagatcagtacattggatcaccagatctggacaggaagatcttgagcggcctcccctgcaagggcaacaacccctccatctgcgcgccgtgccaatcagagaacagctgcaatggagggccgctcaacaccaccaacccctgcaatgacaagcagatgtacagccaccgcttcagctacatgggagctggagcaagggagctggcggcgccatacaacagcttgaccttctttggatatggatggacccacatctcagcagatccaaacaacctcattgatgctgagaagatcactcagatccccgccgtcaaggcctcctccatctctggagatgcaagggtggtgcgcggccctggaagcactggaggagatctggtgaagttctcagctccaagcaacaccttcaccaacatcggcctctggaccaccatccctgctggcatccgcgcctacagggtgaggatcagatatgcaagcaatgctgacatcccgctggatgtgctgatctcaagaactggatatggcaccttcattgctccagcaacaacaacagatctcaacaacctcgcctacaacaagtttggctacctggacaccttggtgttcatgtcagatgagccaaatgagcaatatgagcaggacatcaacttctccctcaaccaggtggcagattctggcaccttgatcctggacaagatcgagttcatccccatg

SEQ ID NO: 166 - DNA, 1956 bp, Artificial Sequence
  synthetic nucleotide sequence encoding toxin protein
atgaactacacagattggatgaacagatgcaactatggagaaagtggagaagttttctcttcagcaagagatggtgtcatcattgcaactggcattggatgggccatccttggcttcatccctgtcattggacctggcctctccgccgccgccggcgtcctcaatgtcatcttgagctacctctggcctgaagatgctggagctcctggaacagaggtggctcagatctcatggaacaggatcttgaggacggtggaaggcctcatcgacactgctctctcttcagtcatcaagacagtggcaacaacagagctgagagatcttcaagaggacatcatcagctacaacctggcgctctgcaacctcaaaacagatccaaacaatgaaacatacaaaacaacagtgagaagagaatttgacaatgctgctgatcaagcaagaaaaaccatcctcgccatgtcacccatcactccagatcaaccagcagaaacaaagaagaatgccatcctgctgctggcagattatgctcaagctgcaaacctccatctgctgctgctgagagatgtcatccaatatggagaaagctggggcttctcgccgctggaggtgcagcagtactatgacaatccatcaggaagaagtgggatgaagcaaaggctggaggagtacaccaactactgcgtcaactggtacaatgttgctctctctgacatcagggcctcaggcgtctacttcgacaacaaatggaggcagttcaatgccttcagaagagacatgaccatcatggtgctggacatcgtcagcttgtggccaacatttgatccaaggctctatcctgtttccaccaagagccagctgacaaggacggtgtacacagatcccattggcattggaagcagctcaggcatcgacttcaccaccgtgccctttgatctggtggagagcagcatcgtcgccgcgccaaagctcttcagctggctgaggaagcaggagttctccttcaaggattgggctgatgtctaccccattgctggatacaagatgaccttccaaaacaccttgtcagctgctctctgggaaggcagcttcattggaacaagagatttgagctatgtggtggagaagcaaaccctcaccattccagatcctcagctcaatgatgacatctggcaaattggaacaaacagcgacagcgtcagaggaacagtttatggatggtacttccccttcacccaatctccagatcaatacattggatcaccagatctggacaggaagatcttgagcggcctgccatgcaaaggaaacaacccaagcatctgcgcgccatgccaatcagaaaacagctgcaatggaggacctctcaacaccaccaacccctgcaatgacaagcagatgtacagccaccgcttcagctacatgggagctggagcaagagagctggctgctccatacaacagcttgaccttctttggatatggatggacacacatctcagcagatccaaacaacttgattgatgctgagaagatcactcagatccctgctgtcaaggcctcctccatctctggagatgcaagggtggtgcgcggccctggaagcactggaggagatctggtgaagttttctgctccaagcaacaccttcaccaacattggcctctggacaaccatccctgctggcatcagggcctacagggtgaggatcagatatgcttcaaatgctgacattcctcttgatgttctcatctcaagaactggatatggaaccttcattgctccagcaacaacaacagatctcaacaacctcgcctacaacaagtttggctacctggacaccttggtgttcatgtcagatgaaccaaatgaacaatatgagcaggacatcaacttctccttgaaccaggtggcagattctggaacattgatcttggacaagattgagttcatccccatg

SEQ ID NO: 167 - DNA, 2082 bp, Artificial Sequence
  synthetic nucleotide sequence encoding toxin protein
atgaacctcaatgacaacaagaatgaatttgagatcctggacagcggcaacctcagctaccagccaagatatcctctagcaaatgttcctggatatgagctgcaaaacatgggctacaagggctggagggacatgtgccctgatgccaagaggcagctgcttggtcaagttggcatctctccatatgatgacacagaaaccttgggcaaggtgctggccatcaccaccggcattgttgctgctctagctggcgtcgccgccaccgccttccctcctcttgctgctgtttctggagtttttggcatcatctccatgatcctggatgttctctggccggagagcgacagccaggtggtgtggggtcaatttgctggagctgctgaagctctggtgggaagaaggatctctgatgagatcaagaaatcagctgacatccagctgaggattgctcaaagcaggctgaaggactaccagcaagcaagctgcaacctccagcgccatccaaacaatgaggtgtacaaggagctcatcagagatgcttttgatgatgctgatgatgctctcaaggacaccatcaagatcttcagcagagaaggatatgagctgctgctgctgctgaactatgttcaagtggccaacctacatctgctgctgctgaaggatgtggtgagatttggtgttggatggggcttcccccagcagagggtggagcagtactacagcaaccccaccaacctgggctctcctggcatggtgcagctgctggctgagtacaccaaccacagcacctcattcttctggcaaggcgtcagggagaaggaggagcaaacaagggactactactggaaccaagaaaaatatgatggctacaggagcgacatgaccatgatggtgctggacatgatcgccatctggccaacatatgatccaagaagatatccatatgcaacagaggtgcagctgacaagaaatgtttattcaactgtcattggagctcagttcaaccagcctcaaaatggctggtacatgatgcccattgagtacacctgggacgcgccgccgcggctggtgagatggattcaagagttcaatggctacacctggaagaatgtttcttctcttgctcaatatgctggcaccaagatcaactacaagtacaccactggaggatcaaccttctgggagagcagaggcatcatcccttctgatggagatggccgcgtctggagcacctactacctctacagcaacttcgtgaaggcaagaagagttggaggaggagtttatccaaaatatgagctggccatcatggacatggtgttcccagattctggaggaggctacttcacctttggaggaggatcagctccaagctactttgaaacatattatgctcctccatgtgaaaacaggccaataaatgccaacaaccctgatgtctgcacgccaaatgaatggctcaatgctcccaccggcgcctgcctctcaaaagggctgaagagccacatgctggctgatgtcatccctggtcactggctcatcgacagcagcgtcgccgacaagcccttcatctccaccttcgccttcgcctggagatcaaccctctgtgaagatttcaacactgttcagccagacaagatcggccagttccccgccgtcaaggccaactggctcagcaatgatggagcaagggtggtgaggagcagcggcaacactggaggagatctggtgcgcctcaatggcgccgccgtgctgaagatggatgttcagttctcagaaagaaggatctacatcatcaggatcagatatgccaccattgctgatgattttggcctcaatgtggtggtgaggaacaatggagacatctacaatgacagcaccatcttccgcctcaacccaacatcaaacaacagcaccacccaatggaccttcgagaactatggatatcaagatgttggaagcctctacccaaatccagatcttggcttctacaatgtttctgtgagcacccaaggagctctggacagccacatggacatcgacaagatcgagttcatccccatcgaggagagcttggaggag

SEQ ID NO: 168 - DNA, 2082 bp, Artificial Sequence
  synthetic nucleotide sequence encoding toxin protein
atgaacctcaatgacaacaagaatgaatttgagatcctggacagcggcaacctcagctaccagccaagatatcctctagcaaatgttcctggatatgagctgcaaaacatgggctacaaaggatggagggacatgtgccctgatgcaaagaggcagctgcttggtcaagttggcatctctccatatgatgacacagaaacattgggcaaggtgctggccatcaccaccggcattgttgctgctctagctggcgtcgccgccaccgccttccctcctcttgctgctgtttctggagtttttggcatcatctccatgatcctggatgttctctggccagagagcgacagccaggtggtttggggtcaatttgctggagctgctgaagctctggtgggaagaaggatctctgatgagatcaagaaatcagctgacatccagctgaggattgctcaaagcaggctgaaggactaccagcaagcaagctgcaacctccagcgccatccaaacaatgaggtgtacaaggagctcatcagagatgcttttgatgatgctgatgatgctctcaaggacaccatcaagatcttcagcagagaaggatatgagctgctgctgctgctgaactatgttcaagtggcaaatctacatctgctgctgctgaaggatgtggtgagatttggtgttggatggggcttcccccagcagagggtggagcagtactacagcaaccccaccaaccttggatctcctggcatggtgcagctgctggctgaatacaccaaccacagcacctcattcttctggcaaggcgtcagggagaaggaggagcaaacaagggactactactggaaccaagaaaaatatgatggctacaggagcgacatgacaatgatggtgctggacatgatcgccatctggccaacatatgatccaagaagatatccatatgcaacagaggtgcagctgacaagaaatgtttattcaactgtcattggagctcagttcaaccagcctcaaaatggatggtacatgatgccaattgagtacacctgggatgctccgccgcggctggtgagatggattcaagagttcaatggctacacctggaagaatgtttcttctcttgctcaatatgctggaacaaagatcaactacaagtacaccactggaggatcaaccttctgggagagcagaggcatcatcccttctgatggagatggccgcgtctggagcacctactacctctacagcaacttcgtgaaggcaagaagagttggaggaggagtttatccaaaatatgagctggccatcatggacatggtgtttccagattctggaggaggctacttcacctttggaggaggatcagctccaagctactttgaaacatattatgctcctccatgtgaaaacaggccaataaatgcaaacaaccctgatgtttgcacgccaaatgaatggctcaatgctcccaccggcgcctgcctctcaaaagggctgaagagccacatgctggctgatgtcatccctggtcattggctcatcgacagcagcgtcgccgacaagcccttcatctccaccttcgccttcgcctggagatcaaccctctgtgaagatttcaacactgttcaaccagacaagattggccagttccctgctgtcaaggccaactggctcagcaatgatggagcaagggtggtgagaagcagcggcaacactggaggagatctggtgaggctcaatggcgccgccgtgctgaagatggatgttcagttctcagaaagaaggatctacatcatcaggatcagatatgccaccattgctgatgattttggcctcaatgtggtggtgaggaacaatggagacatctacaatgacagcaccatcttccgcctcaacccaacatcaaacaacagcaccacccaatggacatttgagaactatggatatcaagatgttggaagcctctatccaaatccagatcttggcttctacaatgtttctgtgagcacccaaggagctctggacagccacatggacatcgacaagattgagttcatccccatcgaggagagcttggaagaa

SEQ ID NO: 169 - DNA, 2004 bp, Artificial Sequence
  synthetic nucleotide sequence encoding toxin protein
atgaacatcaatgacaacaagaatgaatatgagatcctggacagcggcaacctcagctaccagccaagatatcctctggcaagagctcctggatcagaatgccagaagccaaatgccaaggatggcatctacacgccggtgggaagggtggacaccgcgctgcaaaacatcgacatcggcctctccatcaggacggcgctgagcatcctccagatgctgctctctgttagcttccctgctcttggaagagctgctggcctcatcaacatcatcttcggcttcctctggggcacccttgctggtcaatcagtttgggagaagttcatgcgcgccgtggagagcttggtgaaccagaagatcaccgacgccgtccgcgtcaaggcgctctccgagctggaaggagttcaaaatgctctggagctctaccaagaagctgctgatgattggaatgaaaatccaacagatgtgagcaacaaggagcgcgtccgccgccagttcacctcaacaaacaccaccatcgagtacgccatgccctccttcagagttccaaccttcgaggtgccgctgctcaccgtctatgctcaagctgccaacctccacctccagctgctgagagatgctgtcaagtttggaaatgaatgggggatgccatcagaggaggtggaggacatgtacaacaggctgacaaggaggacggcggagtacacagatcattgtgttgcaacatatgacaagggcctcaaggaagcatatgatcttgctccaaatccaacagactacaacaagtacccctacctcaacccatattcaaaagatcccatctatggcaagtactacaccgcgccggtggactggaacctcttcaatgactacaggagggacatgacattaatggtgctggacatcgtcgccgtctggccaacatacaacccaaggatctacaccaacccaaatggcgtccaggtggagctcagcagggaggtgtacagcaccgtctatggaagaggaggaagcaacaacagcagctttgatgccatcgagagccagatcgtccggccgccgcacctggtgacagagctaacaaacctcaagatcgagcaaggagcaaccttggacatggagcagatccagtaccccaagtacatgaaggtcaccaacaccctccactatgttggtagcagcagcacctgggagcagagcagcagcgccatccccatcaggcccatcacccagatccacaccatccccgccaacaacatcggcaacctctccctctcacagctggatgttccctacaggttctccttctacaacaaggatgatgctctgatcgccgccgtcggcgccgagttccctccaaacaccgtcacctggaatggcatccccaaggcggaggacagcaaccagaacagccaccacctcagctatgttggagctcttggaacacaaagctcagctggcttcccctggacatatccaacagagctgctgggagaatggggctttggatggctgcacaacagcttgacgccaacaaatgagatcctctcagacaagatcacccagatccccgccgtcaagggctacctgctggagcgcggcgccaaggtggtgaaggggccaggaagcactggaggagatctcatccagctgccaggagcttctcaaggaaggatcaccatcaacatctcaaatgccttccagaagagcttcatggtgaggatcagatatgctgcaacagctgatggccagctgaagtttggaaggatctcctctgatggaggcatccacagcacctccaccaaatatgtcaccaccggcgccaatgaaaatgtcaacagcctcacctacaacaggttcaagtacacagatgtttatggcgccatggcatcaaacatctacagcggcatcgtgctgatcaatgagatgggaggaagcatctacatcgacaagatcgagttcatccccatcaagggcagcttggaggtgtttgaagcagagcag

SEQ ID NO: 170 - DNA, 2004 bp, Artificial Sequence
  synthetic nucleotide sequence encoding toxin protein
atgaacatcaatgacaacaaaaatgaatatgagatcttggattctggcaacttgagctaccagccaagatatcctcttgcaagagctcctggatcagaatgccagaagccaaatgcaaaagatggcatctacacgcctgttggaagggtggacaccgcgctgcaaaacattgacattggcctctccatcaggacggcgctgagcatcctccagatgctgctctctgttagcttccctgctcttggaagagctgctggcctcatcaacatcatctttggcttcctctggggaactcttgctggtcaatcagtttgggagaagttcatgcgcgccgtggagagcttggtgaaccagaagatcaccgacgccgtccgcgtcaaggctctctcagagctggaaggagttcaaaatgctctggagctctaccaagaagctgctgatgattggaatgaaaatccaacagatgtgagcaacaaggagagggtccgccgccagttcacctcaacaaacaccaccatcgagtatgcaatgccatccttcagagttccaacatttgaggtgccgctgctcaccgtctatgctcaagctgcaaacctccatctccagctgctgagagatgctgtcaagtttggaaatgaatgggggatgccatcagaagaagtggaggacatgtacaacaggctgacaagaaggacagcagagtacacagatcattgtgttgcaacatatgacaaaggcctcaaggaagcatatgatcttgctccaaatccaacagattacaacaagtacccctacctcaatccatattcaaaagatcccatctatggaaaatactacaccgcgccggtggattggaacctcttcaatgattacagaagagacatgacattaatggtgctggacatcgtcgccgtctggccaacatacaatccaaggatctacaccaatccaaatggcgtccaggtggagctcagcagggaggtgtacagcaccgtctatggaagaggaggaagcaacaacagcagctttgatgccattgaaagccagatcgtccggccgcctcatctggtgacagagctaacaaatttgaagattgaacaaggagcaacattggacatggagcagatccagtaccccaagtacatgaaggtcaccaacaccctccattatgttggtagcagcagcacctgggagcaaagcagcagcgccatccccatcaggcccatcacccagatccacaccatccctgccaacaacattggaaacctctccttgtcacagctggatgttccatacagattctccttctacaacaaggatgatgctctgatcgccgccgtcggcgccgagtttcctccaaacaccgtcacctggaatggcatccccaaagcagaggacagcaaccaaaacagccatcatctcagctatgttggagctcttggaacacaaagctcagctggcttcccatggacatatccaacagagctgcttggagaatggggatttggatggctgcacaacagcttgacaccaacaaatgagatcctctcagacaagatcacccagatccctgctgtcaagggctacctgctggagcgcggcgccaaggtggtgaaaggacctggaagcactggaggagatctcatccagcttcctggagcttctcaaggaaggatcaccatcaacatctcaaatgccttccagaagagcttcatggtgaggatcagatatgctgcaacagctgatggccagctgaagtttggaaggatctcttctgatggaggcatccacagcacctccaccaaatatgtcaccaccggcgccaatgaaaatgtcaacagcttgacctacaacagattcaagtacacagatgtttatggagccatggcatcaaacatctacagcggcattgtgctgatcaatgagatgggaggaagcatctacattgacaagattgagttcatccccatcaagggcagcttggaggtttttgaagcagaacaa

SEQ ID NO: 171 - DNA, 2145 bp, Artificial Sequence
  synthetic nucleotide sequence encoding toxin protein
atgaaccaatatgacaacaagaatgaatatgagatcatctgctctgatggcatctatggccagccaagatatcccttcaccaaggctcctggaagcgagctccagcagatgaactacaagaactggctctcaagatgccaaaatgagaacattggcttcaccccagaagaagaagctgtcaagacggcgctcatcatctccaccggcctcgcctgggcgctgctggccgtcatccctggcatcaatgttggcgtcaccgtcggcgccggcgccgccgccgccgccggcgtgctaaatgtgctgatccccttcctcttcccagatcaaactgttgacaaccagccggcgccgccgcagtacacccagaaggagctgatgaaatcagtggaggcgctcacaaggaaggagatccaagaaagcaagagggtggatgctctggcaagatgggaaggcatccaaaccatgggaagagattattatgctgctctctgcgcgctctccaaagatccagacaatgaggagaagaagttcgccgtcagagattcatttgatgatgtggaggaccagctgaagctctccatcccctacttcagagctcaaggatttgagatccagatgctggccatgtatgctcaagctgccaacctccacctcaccatcctcagagatgtggtgagatatggaaaaggatggggcttctcccaagaaaggattgatgaatattatgacagccaaggatcagcaagaaatcctggcctcctccagctgctctccgtctacaccaaccactgcgtcaactggtacaatgttggcctctcccaagaatatggaactggaaactggaacaggttcaatgatttcagaaggaacatgaccatcatggtgctggacatcgtcgccgcctggccaacctacaacccaaggctgtatcctcttccaacagaatcagagctgacaaggacggtgtacacagatctgctgggcaacactggaggaactggcctcaccacagaaggaagccagcccatcggcatcattgaagaaaatgtcaccgtccggccgcagctcttcagatggctgaggagcttggacatgggcgccattgatggagttcaaacaacagtgctgaaaggaggccagcagaagtttgaaacaacaggaagctcaaccatcattgatgaaggatggaaaggagacatcgagattgggatgaagttccaggagcacaacagcctctactggccaatgtcgccggtggccaccaagttcttcaaaggagctgtcaccggcttcgccttcggcctgattgatcttggaagatacagatatctcttcttcttcatggcttcagttcatcttcctcctggaggaagctacttctccggcctcccctgccggccagaaggaaattcagattgtgaagatccatgctcgccggactgcatcaaggaaactcttcctggaagccaagccatctgcatagatccaaacttcctcagcagccaccgcctcagcaatgttggcttcggcatgctcaccgccaatgatcctcaatttgtgacgccgggcaccaagttcgccgcctacttcagctatggatggacccatgcttcagcaaaatctggaaatgtcattgcaagggagaagatcacccagatccccgccgtcaagggctacaagttccaccagagcgcgcgcgtcatcaaggggccaggaagcactggaggtgatctggtgaagctggatgtcaatggaggcttctacatccaggtggtgacagcaagatcagaaacagtttctggctacaccatcaggctgagatatgcaagcaaggcagagatcccgctgctcttcagaatcacagatccagattatggcaacagcatgcaaattccagatcttccagcaacaacatcagatgacaacctcacctacaccgccttcaactactacaacatggggataaggctggaggcctccgccaccagcaaggagatcatcatcttcatgcaaaacctctcagcagaagatgctctcatcctggacaagatcgagttcatccccatggaggagagcttggaagaatatgaagcaaatcaagggctggagaaggcaaggaaggccgtcaatgctctcttcaccagc

SEQ ID NO: 172 - DNA, 2145 bp, Artificial Sequence
  synthetic nucleotide sequence encoding toxin protein
atgaaccaatatgacaacaagaatgaatatgagatcatctgctctgatggcatctatggccagccaagatatcccttcaccaaagctcctggatcagagctccagcagatgaactacaagaactggctctcaagatgccaaaatgaaaacattggcttcactccagaagaagaagctgtcaagacggcgctcatcatctccaccggcctggcatgggcgctgctggctgtcatccctggcatcaatgttggtgtcaccgtcggcgccggcgccgccgccgccgccggcgtgctaaatgttctcatccccttcctcttcccagatcaaactgttgacaaccagccggcgccgccgcagtacacccagaaggagctgatgaaatcagtggaagctctcacaaggaaggagatccaagaaagcaagagggtggatgctcttgcaagatgggaaggcatccaaacaatgggaagagattattatgctgctctctgcgcgctctccaaagatccagacaatgaagagaagaagtttgctgtcagagattcatttgatgatgtggaagatcagctgaagctctccatcccctacttcagagctcaaggatttgagatccagatgctggccatgtatgctcaagctgcaaacctccacctcaccatcttgagagatgtggtgagatatggaaaaggatggggcttctctcaagaaaggattgatgaatattatgattctcaaggatcagcaagaaatcctggcctcctccagctgctctccgtctacaccaaccactgcgtcaactggtacaatgttggcctctctcaagaatatggaactggaaactggaacaggttcaatgatttcagaagaaacatgaccatcatggtgctggacatcgtcgccgcctggccaacctacaatccaaggctgtatcctcttccaacagaatcagagctgacaaggacggtgtacacagatctgctgggcaacactggaggaactggcctcacaacagaaggaagccagcccattggcatcattgaagaaaatgtcaccgtccggccgcagctcttcagatggctgaggagcttggacatgggcgccattgatggagttcaaacaacagtgctgaaaggaggccagcagaagtttgaaacaacaggaagctcaaccatcattgatgaaggatggaaaggagacattgaaattgggatgaagttccaggagcacaacagcctctactggccaatgtcgccggtggccaccaagttcttcaaaggagctgtcactggcttcgcctttgggctgattgatcttggaagatacagatatctcttcttcttcatggcttcagttcatcttcctcctggaggaagctacttctccggcctcccctgccggccagaaggaaattcagattgtgaagatccatgctcgccagattgcatcaaggaaactcttcctggaagccaagccatctgcatagatccaaacttcctcagcagccaccgcctcagcaatgttggatttggcatgctcacagcaaatgatcctcaatttgtgacgcctggcaccaagttcgccgcctacttcagctatggatggacacatgcttcagcaaaatctggaaatgtcattgcaagagagaagatcacccagatccctgctgtcaagggctacaagttccaccagagcgcgcgcgtcatcaaaggaccaggaagcactggaggtgatctggtgaagctggatgtcaatggaggcttctacatccaggtggtgacagcaagatcagaaacagtttctggctacaccatcaggctgagatatgcaagcaaagcagagattcctctcctcttcagaatcacagatccagattatggaaacagcatgcaaattccagatcttccagcaacaacatcagatgacaacctcacctacaccgccttcaactactacaacatggggataaggctggaggcctccgccaccagcaaggagatcatcatcttcatgcaaaatctttcagcagaagatgctctcatcctggacaagattgagttcatccccatggaggagagcttggaagaatatgaagcaaatcaagggctggagaaggcaaggaaggctgtcaatgctctcttcaccagc

SEQ ID NO: 173 - DNA, 1959 bp, Artificial Sequence
  synthetic nucleotide sequence encoding toxin protein
atgaactacaagaactggctctcaagatgccaaaatgagaacattggcttcaccccagaagaagaagctgtcaagacggcgctcatcatctccaccggcctcgcctgggcgctgctggccgtcatccctggcatcaatgttggcgtcaccgtcggcgccggcgccgccgccgccgccggcgtgctaaatgtgctgatccccttcctcttcccagatcaaactgttgacaaccagccggcgccgccgcagtacacccagaaggagctgatgaaatcagtggaggcgctcacaaggaaggagatccaagaaagcaagagggtggatgctctggcaagatgggaaggcatccaaaccatgggaagagattattatgctgctctctgcgcgctctccaaagatccagacaatgaggagaagaagttcgccgtcagagattcatttgatgatgtggaggaccagctgaagctctccatcccctacttcagagctcaaggatttgagatccagatgctggccatgtatgctcaagctgccaacctccacctcaccatcctcagagatgtggtgagatatggaaaaggatggggcttctcccaagaaaggattgatgaatattatgacagccaaggatcagcaagaaatcctggcctcctccagctgctctccgtctacaccaaccactgcgtcaactggtacaatgttggcctctcccaagaatatggaactggaaactggaacaggttcaatgatttcagaaggaacatgaccatcatggtgctggacatcgtcgccgcctggccaacctacaacccaaggctgtatcctcttccaacagaatcagagctgacaaggacggtgtacacagatctgctgggcaacactggaggaactggcctcaccacagaaggaagccagcccatcggcatcattgaagaaaatgtcaccgtccggccgcagctcttcagatggctgaggagcttggacatgggcgccattgatggagttcaaacaacagtgctgaaaggaggccagcagaagtttgaaacaacaggaagctcaaccatcattgatgaaggatggaaaggagacatcgagattgggatgaagttccaggagcacaacagcctctactggccaatgtcgccggtggccaccaagttcttcaagggcgccgtcaccggcttcgccttcggcctcattgatctaggaagatacagatatctcttcttcttcatggcttctgttcatcttcctcctggaggaagctacttctccggcctcccctgccggccagaaggaaattcagattgtgaagatccatgctctccagattgcatcaaggaaactcttcctggaagccaagccatctgcattgatccaaacttcttgagcagccaccgcctcagcaatgttggatttgggatgctgacagcaaatgatcctcagttcgtcacccccggcaccaagttcgccgcctacttcagctatggatggacccatgcttcagcaaaatctggaaatgtcattgcaagggagaagatcacccagatccccgccgtcaagggctacaagttccaccagagcgcgcgcgtcatcaaggggccaggaagcactggaggtgatctggtgaagctggatgtcaatggaggcttctacatccaggtggtgacagcaagatcagaaacagtttctggctacaccatcaggctgagatatgcaagcaaggcagagatcccgctgctcttcagaatcacagatccagattatggcaacagcatgcaaattccagatcttccagcaacaacatcagatgacaacctgacctacaccgccttcaactactacaacatgggcatcaggctggaggcctccgccaccagcaaggagatcatcatcttcatgcaaaacctctctgctgaagatgctctcatcctggacaagatcgagttcatccccatg

SEQ ID NO: 174 - DNA, 1959 bp, Artificial Sequence
  synthetic nucleotide sequence encoding toxin protein
atgaactacaagaactggctctcaagatgccaaaatgaaaacattggcttcactccagaagaagaagctgtcaagacggcgctcatcatctccaccggcctggcatgggcgctgctggctgtcatccctggcatcaatgttggtgtcaccgtcggcgccggcgccgccgccgccgccggcgtgctaaatgttctcatccccttcctcttcccagatcaaactgttgacaaccagccggcgccgccgcagtacacccagaaggagctgatgaaatcagtggaagctctcacaaggaaggagatccaagaaagcaagagggtggatgctcttgcaagatgggaaggcatccaaacaatgggaagagattattatgctgctctctgcgcgctctccaaagatccagacaatgaagagaagaagtttgctgtcagagattcatttgatgatgtggaagatcagctgaagctctccatcccctacttcagagctcaaggatttgagatccagatgctggccatgtatgctcaagctgcaaacctccacctcaccatcttgagagatgtggtgagatatggaaaaggatggggcttctctcaagaaagaattgatgaatattatgattctcaaggatcagcaagaaatcctggcctcctccagctgctctccgtctacaccaaccactgcgtcaactggtacaatgttggcctctctcaagaatatggaactggaaactggaacagattcaatgatttcagaagaaacatgaccatcatggtgctggacatcgtcgccgcctggccaacctacaatccaaggctgtatcctcttccaacagaatcagagctgacaaggacggtgtacacagatctgctgggcaacactggaggaactggcctcacaacagaaggaagccagcccattggcatcattgaagaaaatgtcaccgtccggccgcagctcttcagatggctgaggagcttggacatgggcgccattgatggagttcaaacaacagtgctgaaaggaggccagcagaagtttgaaacaacaggaagctcaaccatcattgatgaaggatggaaaggagacattgaaattgggatgaagttccaggagcacaacagcctctactggccaatgtcgccggtggccaccaagttcttcaagggcgccgtcactggcttcgccttcggcctcattgatctaggaagatacagatatctcttcttcttcatggcttctgttcatcttcctcctggaggaagctacttctctggcctcccctgccggccagaaggaaattcagattgtgaagatccatgctctccagattgcatcaaggaaactcttcctggaagccaagccatctgcattgatccaaacttcttgagcagccaccgcctcagcaatgttggatttgggatgctgacagcaaatgatcctcaatttgtcactcctggaaccaagttcgccgcctacttcagctatggatggacacatgcttcagcaaaatctggaaatgtcattgcaagagagaagatcacccagatccctgctgtcaagggctacaagttccaccagagcgcgcgcgtcatcaaaggaccaggaagcactggaggtgatctggtgaagctggatgtcaatggaggcttctacatccaggtggtgacagcaagatcagaaacagtttctggatacaccatcaggctgagatatgcaagcaaagcagagattcctctcctcttcagaatcacagatccagattatggaaacagcatgcaaattccagatcttccagcaacaacatcagatgacaacttgacatacaccgccttcaactactacaacatgggcatcaggctggaggcctccgccaccagcaaggagatcatcatcttcatgcaaaatctctctgctgaagatgctctcatcttggacaagattgagttcatccccatg

SEQ ID NO: 175 - DNA, 1005 bp, Artificial Sequence
  synthetic nucleotide sequence encoding toxin protein
atgaggaactacaagaagctcgccgtcgccatgccgctggctgggatgatcatgagcggcgtcggcgtgctgggaggaccagcatattcatttgctgacaccatgcctcaagcaaaggtggcgccgatgtacaccaacctcgccgccgccgaccactaccagcagttcatggacatgctgaacagcaaggagatgggaggagaagctgacaacttcgagatcgtcgccatgccagattcagggccaaagaacatccacatcacagaagcaaagcccatcaatgctccagagaacaccaccgaggtgatgagctaccacaatgtttctggcatccagcagagcctcaagacgccaagcaagaagatcacccacaagaacaccttggccatcaagaatggaggaagcatcaagacaagcattgaaagcaagaccaagttctcagttcaagttcccttcttcgccaaaggagaagaagagctgaaggtggggctggatgtcacctacaacagagaaagcaccgacactgctgagaacacccaggagttcaccatcccagagcagacgctgctggcgcagcctggaggaacaacaaggctgatctacaccgtccagagcaccgccttctcaggaacatacaacaccaaggccatcttcaagcagaagcaaggaggagaagcaaagaagattgttgatggcaaggagatagaaggaaaggagctggagaaatggaatgaagaacaaggctactacttcatcaaggggctgctggaggacaagccagaatttggcatcaaggctccagaatttggagacatcttcgtctttgatgatgtcaacaagaaggtgtacctaaaggatggagttttcacctttgaaggacaagctggccatcaaagcacagcagaagctgtgttcatccctgatgacaacaccaagccagaggtgaagatgccgctggcggagtacaacaggagggtggcaaatggcatctccctctatgcaaaa

SEQ ID NO: 176 - DNA, 1005 bp, Artificial Sequence
  synthetic nucleotide sequence encoding toxin protein
atgaggaactacaagaagctcgccgtcgccatgcctcttgctgggatgatcatgagcggcgtcggcgtgctgggaggaccagcatattcatttgctgacaccatgcctcaagcaaaggtggcgccgatgtacaccaacctcgccgccgccgaccactaccagcagttcatggacatgctgaacagcaaggagatgggaggagaagctgacaactttgagatcgtcgccatgccagattcaggaccaaagaacatccacatcacagaagcaaagcccatcaatgctccagaaaacacaacagaggtgatgagctaccacaatgtttctggcatccagcaaagcctcaagacaccaagcaagaagatcacccacaagaacaccttggccatcaagaatggaggaagcatcaagacaagcattgaaagcaagacaaagttctcagttcaagttcccttcttcgccaaaggagaagaagagctgaaggtggggctggatgtcacctacaacagagaaagcaccgacactgctgaaaacacccaagagttcaccatcccagagcagacgctgctggcgcagcctggaggaacaacaaggctgatctacaccgtccaaagcaccgccttctcaggaacatacaacaccaaggccatcttcaagcagaagcaaggaggagaagcaaagaagattgttgatggcaaggagatagaaggaaaggagctggagaaatggaatgaagaacaaggatactacttcatcaaggggctgctggaggacaagccagaatttggcatcaaggctccagaatttggagacatcttcgtctttgatgatgtcaacaagaaggtgtacctaaaagatggagttttcacctttgaaggacaagctggccatcaaagcacagcagaagctgttttcatccctgatgacaacaccaagccagaggtgaagatgccgctggcagagtacaacagaagggtggcaaatggcatctccttgtatgcaaaa

SEQ ID NO: 177 - DNA, 999 bp, Artificial Sequence
  synthetic nucleotide sequence encoding toxin protein
atgaggaagtacaagaagctggcggtggtggtgccgctggctgggatgctgatgagcggcgccggcgtcctcggcggcgccacctcagctcatgctgatggcatcaagattgatggagtgaggacaggaggccagatctccggcaaccagattgctgctgatcactaccagcagttcctcaatgccattggagaagaaggagaagctgacaacttcgagatcgtcgccatgccagattcagggccaaagaacatccacatcacagaagcaaagcccattgatgctccagagaacaccaccgaggtgatgagctaccacaacatcaccggcatccagcagagcctcaagacgccaagcaagaagatcacccacaagaacaccttggccatcaagaatggaggaagcatcaagacaagcattgaaagcaagaccaagttctcagttcaagttcccttcttcgccaaaggagaagaagagctgaaggtggggctggatgtcacctacaacagagaaagcaccgacactgctgagaacacccaggagttcaccatcccagagcagacgctgctggctgctcctggaggaacaacaaggctcacctacaccgtcaaatcaacagccttcaccggcacctacaacaccaaggcgctcttcaagcagaagcaaggaggcaaggccaagaaaatcatcaatggcaaggagctagaaggaaaggagctggagaactggaatgaagaacaaggctacaagttcatcaagtacctgctggagccaaaatggggccagaaggcgccggagtttggagacatcttcgtctttgatgatgccaacaagaaggtgtacctgaaggatggagttttcacctttgaaggacaagctggccatcaatcaacagcagaagctgtgttcatccctgatgacaagaccaagagcgaggtgaagatgccgctggcggagtacaacaagagggtggcaaatggcatctccctctatgcaaaa

SEQ ID NO: 178 - DNA, 999 bp, Artificial Sequence
  synthetic nucleotide sequence encoding toxin protein
atgaggaagtacaagaagctggcggtggtggtgcctcttgctggaatgctgatgagcggcgccggcgtcctcggcggcgccacctcagctcatgctgatggcatcaagattgatggagtgagaactggaggccagatctctggaaaccagattgctgctgatcactaccagcagttcctcaatgccattggagaagaaggagaagctgacaactttgagatcgtcgccatgccagattcaggaccaaagaacatccacatcacagaagcaaagccaattgatgctccagaaaacacaacagaggtgatgagctaccacaacatcaccggcatccagcaaagcctcaagacaccaagcaagaagatcacccacaagaacaccttggccatcaagaatggaggaagcatcaagacaagcattgaaagcaagacaaagttctcagttcaagttcccttcttcgccaaaggagaagaagagctgaaggtggggctggatgtcacctacaacagagaaagcaccgacactgctgaaaacacccaagagttcaccatcccagagcagacgctgctggctgctcctggaggaacaacaaggctcacctacaccgtcaaatcaacagccttcaccggcacctacaacaccaaggctctcttcaagcagaagcaaggaggaaaggccaagaaaatcatcaatggcaaggagctagaaggaaaggagctggagaactggaatgaagaacaaggctacaagttcatcaagtacctgctggagccaaaatggggccagaaggcgccggagtttggagacatcttcgtctttgatgatgcaaacaagaaggtgtacttgaaggatggagttttcacctttgaaggacaagctggccatcaatcaacagcagaagctgttttcatccctgatgacaaaacaaagagcgaggtgaagatgccgctggcagaatacaacaagagggtggcaaatggcatctccttgtatgcaaaa

SEQ ID NO: 179 - DNA, 981 bp, Artificial Sequence
  synthetic nucleotide sequence encoding toxin protein
atggagaatgatgccaagagcatcaaccagaagggcaacagagcagagaacagagaagtttcaatcaaggcggaggagctcaacctggagcagatcctccacaagattggaaatgctcccatcggccagctgatcaactatgactacaccctctacctccactacaacaccaccatctggaaggaagatcccttccatcccttccctgtttctccaaagctggcgccaacatcaggaaatcttccttctccagcaaaatatgccaagctggatggcctccagctgaaggatgtcaagctggtggccaaccctgctgatctcttcaccaccttcaagcccttctacatggctgttggaaacttcgagaacaagacaagcaaccagcaaacatatcaaaccatcgagttctcagaagccatcaccgacagcaccaccatcaccaagaccaagagcttgaaaactggaactgaagtttcaacaaaagcagagctggatgtttttggcctcggcggcgtggaggtcaccgccaaggtgacggtggaaggaacatggagcgacagcaatgctgaaacaaaaacaacaacaaggaccttgaggattcctccaatgtcagtgctggtggaccctggcaagggcgtcagggttcaagcagaggtgctgaaaggagagctgaagaatgtcaacctcaaggcaaatgctctgctgcaaggatcatacatctggcacaaccacagccatgagtacaaaggagacatctatggcttcttgaaaaccatccagatcacccacaacaagcagttcaatgagatcactggaggaggcatcctctttgatgatgcttcaaagagcaccattgctcaaggcctctccctcctctctgctgatgtcaccagcagcagctacagggtggtgctggaagaatatgatctcaagacaggaaacaccaccaagacgacgcccatcaagacctaccagctgaag

SEQ ID NO: 180 - DNA, 981 bp, Artificial Sequence
  synthetic nucleotide sequence encoding toxin protein
atggagaatgatgccaagagcatcaaccagaagggcaacagagcagagaacagagaagtttcaatcaaggcagaagagctcaacctggagcagatcctccacaagattggaaatgctcccatcggccagctgatcaactatgactacaccctctacctccactacaacaccaccatctggaaggaagatcccttccatcccttccctgtttctccaaagctggcgccaacatcaggaaatcttccttctccagcaaaatatgccaagctggatggcctccagctgaaggatgtcaagctggtggccaaccctgctgatctcttcaccaccttcaagcccttctacatggctgttggaaacttcgagaacaagacaagcaaccagcaaacatatcaaaccatcgagttctcagaagccatcaccgacagcaccaccatcaccaagaccaagagcttgaaaactggaactgaagtttcaacaaaagcagagctggatgtttttggcctcggcggcgtggaggtcaccgccaaggtgacggtggaaggaacatggagcgacagcaatgctgaaacaaaaacaacaacaaggaccttgaggattcctccaatgtcagtgctggtggaccctggaaaaggcgtcagagttcaagcagaggtgctgaaaggagagctgaagaatgtcaacctcaaggcaaatgctctgctgcaaggatcatacatctggcacaaccacagccatgagtacaaaggagacatctatggcttcttgaaaaccatccagatcacccacaacaagcagttcaatgagatcactggaggaggcatcctctttgatgatgcttcaaaaagcaccattgctcaaggcctctccctcctctctgctgatgtcaccagcagcagctacagggtggtgctggaagaatatgatctcaagacaggaaacaccaccaagacgacgcccatcaagacctaccagctgaag

SEQ ID NO: 181 - DNA, 975 bp, Artificial Sequence
  synthetic nucleotide sequence encoding toxin protein
atgaagaacaacaagaagaagaagcagatcctctccttggccatgctggcctccattggaacaagcctcggcatcatctctccagattcagtttctgctgctcaaacaaaccccatccagaacaccatccaggagcaaagaaatgtctccatctctgattggaggacgcccatccaggacacctacaaggccgccaagctgagctcgccaaacaggttcctcagcaatgaagcaaggctggagaggctccagatctaccagagctcagtggaagctgatggaagccccaccatcaccgacagcaagagcttgtttgttggaaaaacaaccttgacaaacagaagcaaccaagatcagatcctcaccaccaaccagttctcaaaaacatttgagaacagcatcaccaacagcaccacccatggcttcaacttcggcgtcagcacctccgccaccttcggcatcaagttccttggagaaacaaatgtagagatttcaactgagtacaacttcagcaacaccgtcgccaagacaaaaacagaaagctacacctacaccgccacgccgcagaacatcgtggtgccggccaacagctcagtggaggtcatcgtcaccctcaacaccaacaagatctctggaaatgtcaagctgctcacccatgttgatggagaggtgagatatcaaaacaacccagcaaatcttggaagctggaggattgagaagttcaagggcttcctcggcagcatccatccaaaggacatctcaaacaacctcaaggctcatcctcaaaatggagtttatgtgattggaactggaaactactctgctgaatatggaacagagttctccgtcaccgtccgccccgtcaccaacctcaacacctcgccggccaagagcagcagcatggtttcagagaacagcaaggccaccaatgaaggctacacctacaccgtcaagccagaggtgaagaaggagcag

SEQ ID NO: 182 - DNA, 975 bp, Artificial Sequence
  synthetic nucleotide sequence encoding toxin protein
atgaagaacaacaagaagaagaagcagatcctctccttggccatgctggcctccattggaacaagcctcggcatcatctctccagattcagtttctgctgctcaaacaaaccccatccagaacaccatccaggagcaaagaaatgtctccatctctgattggaggacgcccatccaggacacctacaaggccgccaagctgagctctccaaacaggttcctcagcaatgaagcaaggctggagaggctccagatctaccaaagctcagtggaagctgatggaagccccaccatcaccgacagcaagagcttgtttgttggaaaaacaacattgacaaacagaagcaaccaagatcagatcctcaccaccaaccagttctcaaaaacatttgagaacagcatcaccaacagcaccacccatggcttcaacttcggcgtcagcacctccgccaccttcggcatcaagttccttggagaaacaaatgtagagatttcaactgaatacaacttcagcaacaccgtcgccaagacaaaaacagaaagctacacctacaccgccacgccgcagaacattgtggtgccggccaacagctcagtggaggtcatcgtcaccctcaacaccaacaagatctctggaaatgtcaagctgctcacccatgttgatggagaggtgagatatcaaaacaacccagcaaatcttggaagctggaggattgagaagttcaagggcttccttggaagcatccatccaaaggacatctcaaacaacctcaaggctcatcctcaaaatggagtttatgtgattggaactggaaactactctgctgaatatggaacagagttctccgtcaccgtccgccctgtcaccaacctcaacacctcgccggccaagagcagcagcatggtttcagagaacagcaaggcaacaaatgaaggctacacctacaccgtcaagccagaggtgaagaaggagcag

SEQ ID NO: 183 - DNA, 1722 bp, Artificial Sequence
  synthetic nucleotide sequence encoding toxin protein
atgaagtacaagacaaggaaggatgccaagaggaagtacaagcaggccttcctcgccaccgtcgccaccatgaccctcggcgtcagcaccttgggcaacaacacctccgcctttgctgctgaggaggacaacatctccgtcatcagcagccacaccctcaatgatgttggcattcaagtggagaagatcatccctgacaagacattaagggagaagttcctcaagaccttcgccaccaaggacaccaccaaggtgggcatcaatggcgccttccagttcatcaaggatgctcagaaggatgttccaaacttcaatgacaccttcagaaccttggccatggcctccaccgagctgattccatatgctggcatggtgatctcgccgctcatcggcctcctctggagtgaagaaggaggagtttcagctcagatcatggagatgaggaagcagatcctcaccctcatcgaccagaagttcgacaatgaatatgtcaacaacctcaagacagatttcaagaccctcaacagcaacatcctcaccttggagaagagcttgaactcaaacagcaacaccaatgctgtctactatgctggaaatgacatctacacaacaagaggaaactgggccaaccacatccagcacagcttcgagagcttgatcgaccgcgcctcaagcaaccatgaggtggcctcccttcctctctacaccaaccttgctgttgctcacatcaccttcctcaagtacatgcatgaacatgcaaaaggaccaaagctgaaatatgatgagcagagcttgcagcacttcttcgacaagggcaacctggaggtcatcaccaagaaatatgctgatcacatcaagaaaacatatgatcaaggactacaaaccttcaacaaggacctcaatgagctggatgagaagatcaaggagaggaccaacctcctccagacgccggtgaatggcctcggcaaggagctgaagctcaagaccctcaacaccaagatcaaggagctggaggacaagcatcttcaaacaaacaagcagaacttcattgctctaacatggggagattccaccctccaggccatcctccaaggagaatggaagctggacaacaatgctctctccttcattgacaagaagggcgtcaagaaaacagattggctacagctgggcaccaactggtactacctcaacccagagaagagcgagatcaagaactctgctggagacatcttcaagagcggcgagatggtgacagggaagattgacatcaaaggaaaaacatactacttcaagcctggaactggagagatgaaaactggatgggtgaaggatggagacaaatggtactacttctcaccaaaaaatgacaacaagaactatgatggcaacaccttcaatgaaggagagatgatgacaggatgggtgaaggtggcaaatgaatacttcttcctggcaacagaaaaaggaaatcaaaatgacaacaatgacaaggagaatgctgtcatcttcaacaaaggagagatgatgacaggatggatctatgtcaaggatggcattgccaccaaggagagcaactcaggaggagcttggtactacctcaatgacaagccagaatatggcaccatcggccacatgctgcatgacatcaaggcctccgtcaggaacaaggaaggaaagtacatcgagtacaagtttggagaagatggcaagatgaagtgg

SEQ ID NO: 184 - DNA, 1722 bp, Artificial Sequence; identical to SEQ ID NO: 183
  synthetic nucleotide sequence encoding toxin protein

SEQ ID NO: 185 - DNA, 1560 bp, Artificial Sequence
  synthetic nucleotide sequence encoding toxin protein
atgaagtacaaggacaggacctccgtcaagaggaagtacaagcaggcgctgctggccaccgtcgccaccatgaccttcggcgtcagcacccttggaagctccgcctccgtgttcgccgccgagaatgctgaagctctccaggacactacagattcacttggagctggaggaggagcagatctggagcagcaatggaaggagatggccaaggagctgggagatcatcattctccttctcttcaagcaaaaggagttgctgagctgctgagcaagggcgccttctccgtctacaaggatgctcacagcaacaagggcaacttcaacaacaccttcagaaccctctccatgggcatctcagagtacttcccatatggcaagctggtgatctcgccgctcatcggcctcctctggccagaaactgtctccacccagaacaaccagtttgagagcttgatcaaccagatgtcatccttgatggatcagaagattgaagattttgatctggccaccatcaagaggcagctggaggcgctgaagaaggagatgcaagtttttgagaggctggtgaacagcaagatcctcacagaaggcttctactctgctggatctccagaagaatcagcaaggacaaaagctgctcatcttcaagcaaccttccatgagctcatctccctctgccagaagaacaacctctcagaagcagagctgccgctctacaccaagatcgccaacatccacctcctcttcctggacttcatggacaagaactggaacaagagcaagctccagatagatcagaagagctttgatgctctctatgctgatgacatcaagaatgctgctcaaaaatatgctcagcacatccatgacaccttcatcctctccaaccagaagatcgacaagaagctctcaaacattgctgaaggaagcaaccatcaaacaaccttggaatggctgaggaccaagctggtgagcttgggaaatgatctggagctgaagaagcaaggaaagagcggcagcagcaacagaagcctcgccgccgtccagagggactacaatgcttttgaagaaaaatatgacaagtacagagatctgctcaacaagaagagcacctaccaagaatcaactgttgatgatcctggcttccatgctgctctaggaaaatggaagaaggagagcacagaatggtacttcctggacatgcatggagagaagcaaactggatgggcgctctcatggaacagcaagtactactacctctccaccaaggacaccgacagcaacacagatggagacaccttcaagaagggccagatgtggacaaaatggatgaaggatgctaatggcaactggtactacttctcaccaaccaccaaggatggatatcaagaaggccagatgtggacaggatggatgaaggatgcaaatggcaactggtactacttctctccaacaacagaagatggatatcaagaaggccagatgatctccggcaagaccatctccatctccggcaaggagtacaacttcgacaccaatggcgtctgcaccaaccccaac

SEQ ID NO: 186 - DNA, 1560 bp, Artificial Sequence
  synthetic nucleotide sequence encoding toxin protein
atgaagtacaaggacaggacctccgtcaagaggaagtacaagcaagctctgctggccaccgtcgccaccatgaccttcggcgtcagcacccttggaagctccgcctccgtgttcgccgccgagaatgctgaagctcttcaagacactacagattcacttggagctggaggaggagcagatctggagcagcaatggaaggagatggccaaggagctgggagatcatcattctccttctcttcaagcaaaaggagttgctgagctgctgagcaagggcgccttctccgtctacaaggatgctcacagcaacaagggcaacttcaacaacaccttcagaaccctctccatgggcatctcagagtacttcccatatggcaagctggtgatctcgccgctcatcggcctcctctggccagaaactgtctccacccagaacaaccagtttgagagcttgatcaaccagatgtcatccttgatggatcagaagattgaagattttgatctggccaccatcaagaggcagctggaggcgctgaagaaggagatgcaagtttttgaaaggctggtgaacagcaagatcctcacagaaggcttctactctgctggatctccagaagaatcagcaagaacaaaagctgctcatcttcaagcaaccttccatgagctcatctccctctgccagaagaacaacctctcagaagcagagctgccgctctacaccaagatcgccaacatccacctcctcttcctggacttcatggacaagaactggaacaagagcaagctccagatagatcagaagagctttgatgctctctatgctgatgacatcaagaatgctgctcaaaaatatgctcagcacatccatgacaccttcatcctctccaaccagaagatcgacaagaagctctcaaacattgctgaaggaagcaaccatcaaacaaccttggaatggctgaggaccaagctggtgagcttgggaaatgatctggagctgaagaagcaaggaaagagcggcagcagcaacagaagcctcgccgccgtccagagggactacaatgcttttgaagaaaaatatgacaagtacagagatctgctcaacaagaagagcacctaccaagaatcaactgttgatgatcctggcttccatgctgctctaggaaaatggaagaaggagagcacagaatggtacttcctggacatgcatggagagaagcaaactggatgggcgctctcatggaacagcaagtactactacctctccaccaaggacaccgacagcaacacagatggagacaccttcaagaagggccagatgtggacaaaatggatgaaggatgctaatggcaactggtactacttctcaccaacaacaaaggatggatatcaagaaggccagatgtggacaggatggatgaaggatgcaaatggcaactggtactacttctctccaacaacagaagatggatatcaagaaggccagatgatctccggcaagaccatctccatctccggcaaggagtacaacttcgacaccaatggcgtctgcaccaaccccaac

SEQ ID NO: 187 - DNA, 1047 bp, Artificial Sequence
  synthetic nucleotide sequence encoding toxin protein
atgttcatgccgctggtgcctcaagagagctttgaaaatgacaagaagaacctcaacacccatgtgctgcactacagcagcaaccagctggtggacatcggccaaggagatgtggtgaatgctcctcttccaaagctctccaacaaccccattgacacgccgccatcaactggcaccgccatcaccaagaacccgctgaacctccaggactacctcaccctcaccgtcacctcaacaaacatcaagagcgccacagatgtcagagatgccatcatcggcatcctcgcctccttcttcctctacaagaacaacaacatcccttctcccttccacagcattgttgatgaaagcaacctcaacaagctgatcttctatgattcagaaaggaacaacttcctggatcttggaagcagcaacccggcgccgcctggagaaaacaacatctgcttctacatctccatccccagccacatcgtcaagagagatctgctgaatgaaagctatgtcatcaggaccacccagtacaagtacctggatggaagcctccaggacaggaccatctcaacagattggaagaaaaccatcaccaccggcagcagcaagacaacaacatggggcctcaccgccacccaagggatggagctgagctggacagaaggaggcttccctcttcctgcttctgctgagcagaagatcaccttgagcttggaggagagctatggccaaagcaatgaatattcaacagaaacaagcatcgagaagaactaccacttcgacaagcctggaagcgactacaaatatgatcagtacagatatgccatctaccagctctccaccagctacaagctgaaggatggctgcaccttgatgaatgatctacaaaacctcaacaccgtctttggacctggcaagttcaatgcaaatggcaagtacttcaccttgaagttcaacatctctgatgtgctggtgccggagaacaccatctatgccacccaaacaccagatccaacaccaagcagcttgagcttgatccagaagatgaacatc

SEQ ID NO: 188 - DNA, 1047 bp, Artificial Sequence
  synthetic nucleotide sequence encoding toxin protein
atgttcatgccgctggtgcctcaagagagctttgaaaatgacaagaagaacctcaacacccatgtgctgcactacagcagcaaccagctggtggacatcggccaaggagatgtggtgaatgctcctcttccaaagctctccaacaaccccattgacacgccgccatcaactggcaccgccatcaccaagaacccgctgaacctccaggactacctcaccctcaccgtcacctcaacaaacatcaagagcgccacagatgtcagagatgccatcatcggcatcctcgcctccttcttcctctacaagaacaacaacatcccttctcccttccacagcattgttgatgaaagcaacctcaacaagctgatcttctatgattcagaaaggaacaacttcctggatcttggaagcagcaacccggcgccgcctggagaaaacaacatctgcttctacatctccatcccaagccacatcgtcaagagagatctgctgaatgaaagctatgtcatcaggacaacccagtacaagtacctggatggaagcctccaggacaggaccatctcaacagattggaagaaaaccatcaccactggaagcagcaagacaacaacatggggcctcaccgccacccaagggatggagctgagctggacagaaggaggcttccctcttcctgcttctgctgagcagaagatcaccttgagcttggaggagagctatggccaaagcaatgaatattcaacagaaacaagcatcgagaagaactaccacttcgacaagcctggaagcgactacaaatatgatcagtacagatatgccatctaccagctctccaccagctacaagctgaaggatggctgcaccttgatgaatgatctacaaaacctcaacaccgtctttggacctggcaagttcaatgcaaatggcaagtacttcaccttgaagttcaacatctctgatgtgctggtgccggagaacaccatctatgcaacacaaacaccagatccaacaccaagcagcttgagcttgatccagaagatgaacatc

SEQ ID NO: 189 - DNA, 1023 bp, Artificial Sequence
  synthetic nucleotide sequence encoding toxin protein
atgggcatctacaatgaacatgagaactacttcatcaaccaggacaagaccatcctcttctatgacaagacctcgccaaactacctcatcgagcagagcaagaacatcctggagcatggcttcatcccagagctctccaaggaccccttcgacaagatccccctcaccagcaagagcatccattcaagccagatcaatgcaacagatttcctcaccctcaccttgaggagcgccagagattatccaaaaggcatcaccaacagcctctggaatgagctgctgctgatctgccggaagctggtggcctacttcttccattcaaacatggacatccccatcctctacaacagctatggcatcgagattgatctggacaggatcatgatcgccaagccgctcaacaccatcttcaagaatgagatcctcctctacatctccctccccaacaagtacctcaagcacagctcagagaacatccagctgatgaagtacaccagctacaagctgctggacagcggcctccaagatgccaagatggaaacccactggagccagttcatcaccagcggcctcaacctcaacaccctctgcgagttcctcaccgtcattggatttgagatcaccaacatctcagaaaaaacagtgatccccacctccatcgagcagaagatcaggaactacctcaactacatcttcaacaccaacaacacctacatcaccaaccagatcaagaggaagagctacatcctcaagagcgtcagcagcaactacatctatgacaaatatgcatatgccatctaccagctgacaacagagtacaagctcatcgtcaagaacaacctacaaaacatcctcaccaagatcaacaccgccttcaagcaggagatcctcttccagcagcattttggcaacatcaagctggagatcccccagcagtacatcgtggaagctgacaacctctgcatcatcaggacgccagatcccatcgtcagcaaggagtaccacagcatccagatcatgatc

SEQ ID NO: 190 - DNA, 1023 bp, Artificial Sequence; identical to SEQ ID NO: 189
  synthetic nucleotide sequence encoding toxin protein

SEQ ID NO: 191 - DNA, 933 bp, Artificial Sequence
  synthetic nucleotide sequence encoding toxin protein
atggccatcactgatgttcaaagctctgctgctgatttcatgaactgggccatcccctactacctcaatggcaccgtcaccgcgcagcagttctatccatatgtcatcaagaaccccattgctgttccagagcagctcttcttcgtcaccatccccgtccagaaggtggcttcagttcaagtcatcgagaacaacaccagcctcacccaaagccaaaccttgaagttctcagagaaggccattgaaacaacaacaagcagcaccacagaaggctacaaggtgggcagcggcatcacctccaccagcaagttcagctacaccaccaagatctttggaagcagcatcggcctggagcagaccttcaccgtcaatgtgaacagcgagtacaaccacagcagcactgaaacaacaacacaaacaacagaaaggctctggaaggtcacccagcctgtttcagtgctgccctacacaaggatcgtcgccaccctcaccatcatgggaggagaagttgagatccccatgaccctcaatgccaacctgctgggccaagggctggacacagagtactactgcggcgccgacttctcctctccagattatccaaatgcatggcagcccttcatggccagcaacctctatgacaccagctggccaaacaagccagcttcatttgctggaggaaatggaaatgagctgatcctcaaaggagcttccatcaccaccaatggaccaagcctctacagcaccgtccacttcgagcagacgccgctgccaggatatgaaaggctctcagagccaaagagctggtacagcaatgaggtggtgctgagagatggcaccatgatcaccatcccagatcttgatccagcaacaggaagggtgctgccaagcaagatgccggagcccatcctcgccagcagcaggatcaatgat

SEQ ID NO: 192 - DNA, 933 bp, Artificial Sequence
  synthetic nucleotide sequence encoding toxin protein
atggccatcactgatgttcaaagctctgctgctgatttcatgaactgggccatcccctactacctcaatggaactgtcactgctcagcagttctatccatatgtcatcaagaaccccattgctgttccagagcagctcttcttcgtcaccatccctgttcagaaggtggcttcagttcaagtcattgagaacaacaccagcttgacccaaagccaaacattgaagttctcagagaaggccattgaaacaacaacaagcagcacaacagaaggatacaaggtgggcagcggcatcacctccaccagcaagttcagctacaccaccaagatctttggaagcagcattgggctggagcaaaccttcaccgtcaatgtgaacagcgagtacaaccacagcagcactgaaacaacaacacaaacaacagaaaggctctggaaggtgacacagcctgtttcagttcttccctacacaaggatcgtcgccaccctcaccatcatgggaggagaagttgagatccccatgacattgaatgcaaacctgctgggccaagggctggacacagaatactactgcggcgccgacttctcttctccagattatccaaatgcatggcagcccttcatggcaagcaacctctatgacacaagctggccaaacaagccagcttcatttgctggaggaaatggaaatgagctgatcctcaaaggagcttccatcaccaccaatggaccttctctctacagcaccgtccattttgagcagacgccgctgccaggatatgaaaggctctcagaaccaaaaagctggtacagcaatgaggtggtgctgagagatggaacaatgatcaccatcccagatcttgatccagcaacaggaagggtgctgccaagcaagatgccagagcccatcctggcaagctcaaggatcaatgat

SEQ ID NO: 193 - DNA, 945 bp, Artificial Sequence
  synthetic nucleotide sequence encoding toxin protein
atggccatcaccgacatcagatctgcttcagaagattatttgagatggcatgctcagtactactggggcggcgccaccctccaaaccatgggcttctacccctacctggtgcaaaaccccattgctgttccagatcaaacagtttttgaggtggtgccagttcagaagatctccgccgtccaggtgctgacaaatgattcagatcaagaacaaacccagattgtggacttctcagagaagatcattgaaacaacaacaagcaccaccacagaaggctacaagattggcagcggcatcacctccaccagcaagtttggctacagcttgaagatcctctccaccaccaccggctttgatcaaaccttcaccctcaacaccacctcagagtacaaccacagcagcacagaaacaacaacacaaacaacagaaaggctctgggagctcacccagccggtgagggtggcgccaagaagccaggtgatctccaccctcaccgtctttggaggaaaagcagagatccccatgaccctcaatgccaacctgctgggtcaaggagtttcaaatggagctcctgaggtgtacagcgacctcaccttgaggaaaacagatggaagcacctggtacaactgggtgtatgcaagccagatgtacgacctcgcctggacagggaagcctgtcagcttcgccggctacaccggccattcattgatcctcaaaggagctgctgtcaccaccaccggcccctgcctctacagcaccgtcagatttgatgaaactcctcttcctggatatgagaaggacagcaagccaagaagctggtactcaaatgaggtgctgctgagggacaggaccatcatcaccatcccagatcttgatccaaaaactggaaggccgctgccgccaaaaggaccagagcccatcctggtgagcagcaggatcaatgat

SEQ ID NO: 194 - DNA, 945 bp, Artificial Sequence
  synthetic nucleotide sequence encoding toxin protein
atggccatcaccgacatcagatctgcttcagaagattatttgagatggcatgctcaatactactggggcggcgccaccctccaaacaatgggcttctacccctacctggtgcaaaatccaattgctgttccagatcaaacagtttttgaggtggttcctgttcagaagatctccgccgtccaggtgctgacaaatgattcagatcaagaacaaacacaaattgtggacttctcagagaagatcattgaaacaacaacaagcacaacaacagaaggatacaagattggaagcggcatcacctccaccagcaagtttggctacagcttgaagatcctctccaccaccactggatttgatcaaaccttcaccttgaacaccacctcagagtacaaccacagcagcacagaaacaacaacacaaacaacagaaaggctctgggagctcacccagccggtgagggtggcgccaagaagccaggtgatctccaccctcaccgtctttggaggaaaagcagagatccccatgaccttgaatgcaaaccttcttggtcaaggagtttcaaatggagctcctgaggtgtacagcgacctcaccttgaggaaaacagatggaagcacctggtacaactgggtgtatgcttctcagatgtatgatctggcatggacaggaaagcctgtcagctttgctggctacaccggccattcattgatcctcaaaggagctgctgtcaccaccaccggcccctgcctctacagcaccgtcagatttgatgaaactcctcttcctggatatgagaaggacagcaagccaagaagctggtattcaaatgaggtgctgctgagggacaggaccatcatcaccatcccagatcttgatccaaaaactggaaggccgctgccgccaaaaggaccagagcccatcctggtgagctcaaggatcaatgat

SEQ ID NO: 195 - DNA, 933 bp, Artificial Sequence
  synthetic nucleotide sequence encoding toxin protein
atgatcatgatcaccaacatcgagcagagcaccatcaactacatgatctggtatgccacccactacctccatgcaaatccaaacaccttctacaacatcggcctctatccatatgagatccacaacctctccatcgtccccaagttcaacaggatcaccgtgaacccttcacagaaggacaccgtcatccaaaccatcgagaacaacacagatgtggagcagcacaggatcatcgagttctatgaaaaaacaacagagaacatcaccaacaggaccaccgccggctacagcatctatgaaggcatcaagagcaccttcacctgcaacatccaggtgaacttcatcatctctggagggctggaggagagcttggagatccctgttcattcagaatgcaaatgctatgaaacagaaacaacaaacaccacctgctccaagctctggaaggtgaagcaaaatgtgatgatcccgccgcacagcaggatcaatgcttccttgatcatcatgggcaccaacatcaagatccccatgcagctctccgccaacatcaagggcacccatgttcacaacaacaagagcaactacttctcaagcctctccttccagcagcatgatggaagcaaggtgagagctcagttctgcgccagcaacctctcccaagatgcatggccaaacaagccagcttccttcagatctcctgggccatacagcagcctcaacctcaaaggagatgccatcaccaccatcgagcctggcctctatgccatgatcagatttgagcagctgcccatcaatggatattcaagagaaggaaagatctggtacagcgaccagatcatcctcagagatggaagggagatcaggctgccaaacttcgacctcctcaccggcaaggcaagctgcattgatgtggacatgaccatcattggaaat

SEQ ID NO: 196 - DNA, 933 bp, Artificial Sequence
  synthetic nucleotide sequence encoding toxin protein
atgatcatgatcaccaacatcgagcagagcaccatcaactacatgatctggtatgccacccactacctccatgcaaatccaaacaccttctacaacatcggcctctatccatatgagatccacaacctctccatcgtccccaagttcaacaggatcaccgtgaacccttcacagaaggacaccgtcatccaaaccatcgagaacaacacagatgtggagcagcacaggatcatcgagttctatgaaaaaacaacagagaacatcaccaacaggaccaccgccggctacagcatctatgaaggcatcaagagcaccttcacctgcaacatccaggtgaacttcatcatctctggagggctggaggagagcttggagatccctgttcattcagaatgcaaatgctatgaaacagaaacaacaaacaccacctgctccaagctctggaaggtgaagcaaaatgtgatgatcccgccgcacagcaggatcaatgcttccttgatcatcatgggcaccaacatcaagatccccatgcagctctccgccaacatcaagggcacccatgttcacaacaacaagagcaactacttctcaagcctctccttccagcagcatgatggaagcaaggtgagagctcagttctgcgccagcaacctctcccaagatgcatggccaaacaagccagcttccttcagatctcctgggccatacagcagcctcaacctcaaaggagatgccatcaccaccatcgagcctggcctctatgccatgatcagatttgagcagctgcccatcaatggatattcaagagaaggaaagatctggtacagcgaccagatcatcctcagagatggaagagagatcaggctgccaaacttcgacctcctcaccggcaaggcaagctgcattgatgtggacatgaccatcattggaaat

SEQ ID NO: 197 - DNA, 2163 bp, Artificial Sequence
  synthetic nucleotide sequence encoding toxin protein
atgaaaagcaagaatcaagatatgaatcaaagattgagttacaacacaactgttgacaaaaattcaacagattctttgagaaatgaaacagatattgaattgaagaacatcaatcatgaagatttcttgaggatgagtgaacatgaaagcattgatccatttgtttctgtttcaacaattcaaactggaattggaattgctggaaaaattcttggaactcttggagttccatttgctggacaaattgcttctctttattctttcattcttggagaattgtggccaaaaggaaaatctcaatgggaaattttcatggaacatgttgaagaattgattgatcaaaagatttcaacatatgcaagaaacattgctcttgctgatttgaaaggattgggagatgctcttgctgtttatcatgaaagtttggaaagttggatcaagaacagaaacaatgcaagagcaacaagtgttgtgaaaagccaatatattgctttggaattgttgtttgttcaaaaacttccttcatttgctgtttctggtgaagaagttcctcttcttccaatttatgctcaagctgcaaatcttcatcttcttcttctcagagatgcttctgtttttggaaaagaatggggattgagcaattctcaaatttcaacattttacaacagacaagttgaaagaacttcagattattctgatcattgtgtgaaatggtattcaactggattgaacaatttgagaggaacaaatgctgaaagttgggtgagatacaatcaattcagaaaagatatgacattgatggttttggatttggttgctttgtttccttcttatgatactttggtttatccaatcaaaacaacttctcaattgacaagagaagtttacactgatgcaattggaactgttcatccaaatgcttcttttgcttcaacaacttggtacaacaacaacaacaatgttccttctttttctgtgattgaagctgctgttgtgagaaatcctcatttgttggatttcttggaacaagttacaatttattctcttctttcaagatggagcaacactcaatatatgaacatgtggggaggacatagattggagttcagaacaattggaggagcaatcaacacttcaactcaaggatcaacaaacacttcaatcaatccagtgattcttcctttcacttcaagagatgtttacagaacagaaagtttggctggattgaatttgtttctcactcaaccagtgaatggagttccaagagttgattttcattggaaatttgcaactcttccaattgcttcagacaatttttattatcctggatatgctggaattggaactcaacttcaagattcagaaaatgaacttcctccagaaacaaaaggacaaccaaattatgaaagctattctcacaggctcagccacattggattgatttctgcttctcatgtgaaagcattggtttattcttggacacacagaagtgctgaaagaacaaacacaattgaaccaaattcaatcactcaaattcctttggtgaaagcattcaatctttcttctggtgctgctgttgtgaaaggaccaagattcactggtggagatattttgagaagaacaaacactggaacatttggagatatcagagtgaacatcaatcctccatttgctcaaagatacagagtgagaatcagatatgcttcaacaactgatcttcaatttcacacttcaatcaatggaagagcaatcaatcaaggaaattttcctgcaacaatgaacagaggagaagatttggaatacagaactttcagaactgttggattcacaacaccattttctttttctgatattcaatcaacattcacaattggagcttggaatttttcttctggaaatgatgtttacattgacagaattgaatttgttcctgttgaagtgacatatgaagcagaatatgattttgaaaaagctcaagaagaagtcactgctttgttcacttcaacaaatccaaaaggattgaaaactgatgtgacagattatcacattgatcaagtttcaaatttggtggaaagtttgagtgatgaattttatttggatgaaaaaagagaattgtttgaaattgtgaaatatgcaagacaattgaacattgaaagaaacatg

SEQ ID NO: 198 - DNA, 2163 bp, Artificial Sequence
  synthetic nucleotide sequence encoding toxin protein
atgaaaagcaaaaatcaagatatgaatcaaagattgagttacaacacaactgttgacaaaaattcaacagattctttgagaaatgaaactgatattgaattgaagaacatcaatcatgaagattttttgaggatgagtgaacatgaaagcattgatccttttgtttctgtttcaacaattcaaactggaattggaattgctggaaaaattcttggaactttgggagttccttttgctggacaaattgcttctctttattctttcattcttggagaactttggccaaaaggaaaaagccaatgggaaattttcatggaacatgttgaagaattgattgatcaaaagatttcaacttatgcaagaaacattgctttggctgatttgaaaggattgggagatgctttggctgtttatcatgaaagtttggaaagttggatcaaaaacagaaacaatgcaagagcaacttcagttgtgaaaagccaatatattgctttggaattgctttttgttcaaaaacttccttcttttgctgtttctggtgaagaagttcctttgcttccaatttatgctcaagctgcaaatcttcatcttcttcttctcagagatgcttctgtttttggaaaagaatggggattgagcaattctcaaatttcaacattttacaacagacaagttgaaagaacttcagattattcagatcattgtgtgaaatggtattcaactggtttgaacaatttgagaggaacaaatgctgaaagttgggtgagatacaatcaattcagaaaagatatgacattgatggttttggatttggttgctttgtttccttcttatgatactttggtttatccaatcaaaacaacttctcaattgacaagagaagtttacactgatgcaattggaactgttcatccaaatgcttcttttgcttcaacaacatggtacaacaacaacaacaatgttccttctttttcagtgattgaagctgctgttgtgagaaatcctcatttgttggattttttggaacaagttacaatttattctttgctttcaagatggagcaacactcaatatatgaacatgtggggaggacatagattggagttcagaacaattggaggagcaatcaacacttcaactcaaggatcaacaaacacttcaatcaatccagtgattcttcctttcacttcaagagatgtttacagaacagaaagtttggctggtttgaatttgtttttgacacaaccagtgaatggagttccaagagttgattttcattggaaatttgcaactcttccaattgcttcagacaatttttattatcctggatatgctggaattggaactcaacttcaagattcagaaaatgaacttcctccagaaactaaaggacaaccaaattatgaaagctattctcacagattgagccatattggattgatttctgcttctcatgtgaaggctttggtttattcttggacacacagaagtgctgaaagaacaaatacaattgaaccaaattcaatcactcaaattcctttggtgaaggctttcaatctttcttctggagctgctgttgtgaaaggaccaagattcactggtggagatattttgagaagaacaaacactggaacttttggagatatcagagtgaacatcaatcctccttttgctcaaagatacagagtgagaatcagatatgcttcaacaactgatttgcaatttcatacaagcatcaatggaagagcaatcaatcaaggaaattttccagcaacaatgaacagaggagaagatttggaatacagaactttcagaactgttggatttacaactccattttctttttctgatattcaatcaactttcaccattggagcttggaatttttcttctggaaatgatgtttacattgacagaattgaatttgttcctgttgaagtgacatatgaagctgaatatgattttgaaaaagctcaagaagaagttactgctttgttcacttcaacaaatccaaaaggattgaaaactgatgttacagattatcatattgatcaagtttcaaatttggtggaaagcctttctgatgaattttatttggatgaaaaaagagaattgtttgaaattgtgaaatatgcaaggcaattgaacattgaaagaaacatg

SEQ ID NO: 199 - DNA, 960 bp, Artificial Sequence; identical to SEQ ID NO: 135
  synthetic nucleotide sequence encoding toxin protein

SEQ ID NO: 200 - DNA, 960 bp, Artificial Sequence
  synthetic nucleotide sequence encoding toxin protein
atggtgagaatttatccaagattgaatgaattgatcagagaagctgcaagaaaatgggcagaaaacaatcaattcagatttttgagaagcactcttcttgatccagatacaaatgatgaaactgttgtgatgaacacaacattcacagaaattggttcaccagaagaatgcatggatttggaacctcttcaaatcaagcaaagtttcacaaacaacactgatcaacaaacaacagaaattttcagagatgttgtttatgttgaagatgatttcacttgggaaaatgaatatgagttcaacatttcagaattgaaattgttgacaattccaagagttccaaaattggcttacaaagatatcaatcctggatttcaagttgatttgtttggaccaaacagagttttttcaacaaagatgagagaaatgaggccattgagagcagaagttttcttggaacctcattcttctgtcaatttgaaagcaaaagttgaaagacaacaattttctcaagaatatcaattggagctttcaattcaaggagatgttgttgtgacaacagaaagaacaactggagaaagtgaagaatattatgtttctttgagagatttgattcctttctttgttcttccaaacaatttcactttggaaggacaagcattggttttcagagaaaaaggaaaattcactggaattttgtacagagcaattcatctttatgtcactcaaacattatacaatgaaagaaaaattttggaatatgaaattcctcttcttcctccattggatgatttgagaagcagattggtggaagcaattggagcaagaaggctttctcctcaagaagatgagttcactgttgtttcttcaacttctcaaactgttcctccaaaagaacaagatcaatgtggatgttcttcttgtctttcttctcaaagcaacacaaatctttacactgatcaa

SEQ ID NO: 201 - DNA, 960 bp, Artificial Sequence
  synthetic nucleotide sequence encoding toxin protein
atggtgagaatttatccaagattgaatgaattgatcagagaagctgcaagaaaatgggctgaaaacaatcaattcagatttttgagaagcactttgcttgatcctgatacaaatgatgaaactgttgtgatgaatacaactttcactgaaattggttcaccagaagaatgcatggatttggaaccattgcaaatcaagcaaagtttcacaaacaacactgatcaacaaacaacagaaattttcagagatgttgtttatgttgaagatgatttcacttgggaaaatgaatatgagttcaacatttcagaattgaagctgttgacaattccaagagttccaaaacttgcttacaaagatatcaatcctggatttcaagttgatttgtttggaccaaacagagttttttcaacaaagatgagagaaatgaggccattgagagctgaagttttcttggaacctcattcttcagtgaatttgaaagcaaaagttgaaagacaacaattttctcaagaatatcaattggagctttcaattcaaggagatgttgttgttacaacagaaagaacaactggagaaagtgaagaatattatgtttctttgagagatttgattcctttctttgttcttccaaacaatttcactttggaaggacaagcattggttttcagagaaaaaggaaaattcactggaattttgtacagagcaattcatctttatgttactcaaactttatacaatgaaagaaagattttggaatatgaaattcctttgcttcctcctttggatgatttgagaagcagattggtggaagcaattggagcaagaaggctttctcctcaagaagatgaatttactgttgtttcttcaacttctcaaactgttcctccaaaagaacaagatcaatgtggatgttcttcttgtctttcttctcaaagcaacacaaatctttacactgatcaa

SEQ ID NO: 202 - DNA, 2367 bp, Artificial Sequence
  synthetic nucleotide sequence encoding toxin protein
atgttggaagatgcaatcaagaacaaagatactcaaatcactccagaattgatcaagaaattgcaagacaaaggatttgattatctttcaattgtgaaaggattgactggaggattgttgaagcaaattccatatgctggaagcattctttctcctcttgttgttggattgtttcctggaaaaggatatgttacaaaagcaaatgtttggggagaaattcaagacagagtttcaaatttgattgatcaaaaattggaagaaagccaagtgaacaatttgattggaaaattgactggaatccaagacaatcttggaatttatcaaacaagagttggattggtgaatggaatcaaaccaccaattgcaaatttcattcaaaaagatgcaaattcagacaagaacaaagaaaatttgagaagcacaattgattctttggacaaagatcttggaagagtgattccagaatttgctgtgaaaggatatgaagctgcttctcttccatattatgttcaagttgcaaatgttcatttgtttcttctcaaagatgctttgacacatgctgatgaatggggattgacagatgatgaaaaaagaggatatctttcaagattgcaacaaaagattcaagaatattcttctgttgtttatgattctttcaacaaaggagttgaagctgcaaaatcaaaaggaggaagcactgctgattcttggaacagaacaaatgcttatgtgagaacaatgacattgtatggattggattttgttgctctttggccagcttttgatacaaagcattacaatcaaccagtgaagctgcaacaaacaagagaactttattcaaatatgattggaaggccaatcaattggcaagattatgatacaacattgcaacaaattcacaattctggatatgctggatatcctggagaattgaagcaagttggagtttctcaatgggacagaattgatggaatcagagaaatttttgattggactggagatggaagcagagattacactcttcaatggggacatgcaaacaagaatggatattcagacagaagccaaacagtgaacaatccagcaattggaatttctgcttatgaaagcaacaatgcaaatttctacaacatgtcaacaatcacttacaagcaaaacaatgaagtttcttggttttatggaccattcacaactcaaagtgattcaaaagatggaagcagaattgattcaaaagctcctgctggacacaaactttcaagagtgaaggttcaagaaaaaagaagtgatttgaacacaatttcttcttttgttgctgcttatgttccagaagaagttcatcctcaaaacattttggaagcaaaagcaatcactggagttcctgctgaaaaatatttggctcatgctggatttgaagataaaattgaatatatgaatggaagcaatgcaatggtttcttcaaagaatggagatacaattgattacaatgttcaatctcctggaaaacaaaaatacaaaatcagattgagagttgcaacaaattctgatacttctgttggaatttcaatcaatggagattctcaacaagtgaacatcaagaacacagaagctgcaacaaaattggaagatggaatcactgtgaaaggagtgaatggaaaatatatgttgattgatggaccaactgttgaactttcagaaggtgtcaacacaattcaattgaaaaattctggtggagcaaaaattgctttggacagaattgaatttgaaccaattggaggagaattgagaaaatggaagcaagaaggagacaaatggtatttttatgatgaaaatgacaagaaattaactggatggcaaaagatcaatgaaagaaaatattatcttggacattctggagatggaagtggaatgacaacagaaggagaaatggcaactggatggaaaacaattgatggagttcaatattattttggacactcaggagatggaagtggaatggtgacagaaggagaaatggcaactggatggaaaacaatcaatggagtgaaatattattttggacaaactggagatggatcaggaatgcaacatgaaggagaaaaagcaactggatggaaaacaattgatggagtgaaatattatttcaacaaaactggagatggaagtggaatgcaacatgaaggagaaaaagcaattggatggaaaacaattgatggagtgaaatattatttcaacaaaactggagatggatcaggaatgcaacatgaaggagaaatggctcttggagatatgacaattgatggagtgaagcatcatttcaacaaaactggagatggaactggaagagatcatgaaggagaattggtttgg

SEQ ID NO: 203 - DNA, 2367 bp, Artificial Sequence
  synthetic nucleotide sequence encoding toxin protein
atgttggaagatgcaatcaaaaacaaagatactcaaatcactccagaattgatcaagaaacttcaagacaaaggatttgattatctttcaattgtgaaaggattgactggtggattgttgaagcaaattccttatgctggaagcattctttctcctttggttgttggattgtttcctggaaaaggatatgttacaaaagcaaatgtttggggagaaattcaagacagagtttcaaatttgattgatcaaaaattggaagaaagccaagtgaacaatttgattggaaaattgactggaatccaagacaatttgggaatttatcaaacaagagttggattggtgaatggaatcaaaccaccaattgcaaatttcattcaaaaagatgcaaattcagacaaaaacaaagaaaatttgagaagcaccattgattctttggacaaagatttgggaagagtgattccagaatttgctgtcaaaggatatgaagctgcttctcttccttattatgttcaagttgcaaatgttcatttgtttttgttgaaagatgctttgacacatgctgatgaatggggattgactgatgatgaaaaaagaggatatctttcaagattgcaacaaaagattcaagaatattcttctgttgtttatgattctttcaacaaaggagttgaagctgcaaaaagcaaaggaggatcaactgctgattcttggaacagaacaaatgcttatgtgagaacaatgacattgtatggattggattttgttgctctttggccagcttttgatacaaagcattacaatcaaccagtgaagctgcaacaaacaagagaactttattcaaacatgattggaaggccaatcaattggcaagattatgatacaactttgcaacaaattcacaattctggatatgctggatatcctggagaattgaagcaagttggagtttctcaatgggacagaattgatggaatcagagaaatttttgattggactggagatggatcaagagattacactttgcaatggggacatgcaaacaaaaatggatattcagacagaagccaaacagtgaacaatccagcaattggaatttctgcttatgaaagcaacaatgcaaatttttacaacatgtcaacaatcacttacaagcaaaacaatgaagtttcttggttttatggaccatttacaactcaaagtgattcaaaagatggatcaagaattgattcaaaagctcctgctggtcacaaactttcaagagtgaaggttcaagaaaaaagaagtgatttgaacaccatttcttcttttgttgctgcttatgttccagaagaagttcatcctcaaaacattttggaagcaaaagcaatcactggagttcctgctgaaaaatatttggctcatgctggatttgaagataaaattgaatatatgaatggaagcaatgcaatggtttcttcaaaaaatggagatacaattgattacaatgttcaatctcctggaaaacaaaaatacaaaatcagattgagagttgcaacaaattctgatacttctgttggaatttcaatcaatggagattctcaacaagtgaacatcaaaaacactgaagctgcaacaaaattggaagatggaatcactgtgaaaggagtgaatggaaaatatatgttgattgatggaccaactgttgaactttcagaaggtgtcaacacaattcaattgaaaaattctggtggagcaaagattgctttggacagaattgaatttgaaccaattggaggagaattgagaaaatggaaacaagaaggagacaaatggtatttttatgatgaaaatgacaagaaattaactggatggcaaaaaatcaatgaaagaaaatattatttgggacattctggagatggaagtggaatgacaacagaaggagaaatggcaactggatggaaaacaattgatggagttcaatattattttggacactcaggagatggaagtggaatggtgacagaaggagaaatggcaactggatggaaaacaatcaatggagtgaaatattattttggacaaactggagatggatcaggaatgcaacatgaaggagaaaaagcaactggatggaaaacaattgatggagtgaaatattatttcaacaaaactggagatggaagtggaatgcaacatgaaggagaaaaagcaattggatggaaaacaattgatggagtgaaatattatttcaacaaaactggagatggatcaggaatgcaacatgaaggagaaatggctttgggagatatgacaattgatggagtgaagcatcatttcaacaaaactggagatggaactggaagagatcatgaaggagaattggtttgg

SEQ ID NO: 204 - DNA, 2577 bp, Bacillus thuringiensis
atgaaaaataaaaagaaatatatgaagccactcgcagtaggcttgctcgcaactaacattattggatttggtactcagacagtagcgtttgctgcgacagataaagcgggttccaaagaacagatgcagcaacaaatgaaaacacagaataagagctttaatccgacagtattagccagtatgccatcggatacatcggagcttcaaaaaatgttggaagacgcgattaaaaataaggatacccagattactccggaattaataaaaaaacttcaggacaaaggatttgattaccttagtattgtaaagggtttaactggcggattactgaagcaaattccgtatgcaggttcaatcctctcccctttggtagttggcctttttccaggtaagggttatgtaacgaaggcgaatgtctggggagagatacaggatcgcgtttcaaatttaatagatcaaaaattagaagagtcacaagtaaataacttaattgggaaactaacgggtattcaggataatttaggaatataccaaactcgggttggtttagttaatgggataaaaccaccaattgctaattttatacaaaaggatgcaaattctgataaaaataaggagaatttaagaagcacaatagactccttggacaaggatttaggccgagtgatacctgagtttgctgttaaaggttacgaggcagcttctcttccatattatgtacaagttgccaatgtgcatcttttcttattgaaagatgcacttacacatgcagatgagtgggggcttactgatgatgaaaagagaggatatttgtcaagacttcaacaaaaaattcaagagtatagcagcgtcgtatatgattcctttaataaaggagtcgaagccgctaaaagtaagggtggaagtaccgccgacagttggaacagaaccaatgcctatgtaagaacaatgacattgtatggtttagattttgtggctttatggccggcttttgatactaaacattataatcagccagtaaaattgcagcaaacacgtgaattatattctaacatgataggaagaccaataaactggcaagactatgatacaactcttcaacaaattcataatagtgggtatgcgggttatccaggcgagctgaaacaagttggtgtttcacagtgggatcgtattgatggaatcagggaaatatttgattggactggagacggctcacgagattatacgctacaatggggccacgcaaacaaaaatgggtattcggaccgtagccagaccgtcaataacccagcaataggaatttcagcatatgaatccaataatgctaatttctataatatgtctactatcacatataaacaaaataacgaagtatcttggttctatggtccatttactactcaaagcgatagtaaagatggaagtagaatagatagcaaagctccagcgggccataaattatctcgcgtcaaagtacaagaaaaaagatcagatctaaatacaatatcatcttttgtggctgcatatgttcctgaagaagttcatccacagaatatacttgaggctaaagctattacaggggtaccagctgaaaaatatctcgcacatgcaggatttgaagataagattgaatacatgaatggttcgaatgcgatggtatcttctaaaaatggtgacacgatagattacaatgttcaaagtccaggaaaacaaaaatataaaatacgcctccgtgttgcgacaaatagtgacacatctgtgggaatctctataaatggggattctcagcaagtgaatataaaaaatacagaagccgcaacaaagttagaagacggtattacagttaaaggtgtaaatgggaagtacatgttaattgacggaccaactgttgaacttagcgaaggtgtgaatacaattcagcttaaaaatagtggtggagctaagattgcattagatcgaatagaatttgagcctataggcggtgagctacgcaagtggaaacaggaaggtgataagtggtacttttacgatgaaaatgataaaaagttaacaggttggcaaaagattaatgaaagaaaatactaccttggacattctggtgatggttctggtatgaccactgaaggggagatggcaacaggctggaaaacgattgatggagtacaatattactttggacattctggtgatggttctggtatggtcactgaaggggagatggcaacaggctggaaaacgataaatggagtaaaatattattttggacagactggtgatggctctggtatgcaacacgaaggggaaaaggcaacaggctggaaaacgattgatggagtaaaatattacttcaataaaactggtgatggctctggtatgcaacacgaaggggaaaaggcaataggctggaaaacgattgatggagtaaaatattacttcaataaaactggtgatggctctggtatgcaacacgaaggagaaatggcattaggagatatgacgattgatggagtaaaacatcactttaataaaactggtgatggaacgggtcgcgaccatgaaggagagctcgtatgg

SEQ ID NO: 205 - protein, 859 aa, Bacillus thuringiensis
MKNKKKYMKPLAVGLLATNIIGFGTQTVAFAATDKAGSKEQMQQQMKTQNKSFNPTVLASMPSDTSELQKMLEDAIKNKDTQITPELIKKLQDKGFDYLSIVKGLTGGLLKQIPYAGSILSPLVVGLFPGKGYVTKANVWGEIQDRVSNLIDQKLEESQVNNLIGKLTGIQDNLGIYQTRVGLVNGIKPPIANFIQKDANSDKNKENLRSTIDSLDKDLGRVIPEFAVKGYEAASLPYYVQVANVHLFLLKDALTHADEWGLTDDEKRGYLSRLQQKIQEYSSVVYDSFNKGVEAAKSKGGSTADSWNRTNAYVRTMTLYGLDFVALWPAFDTKHYNQPVKLQQTRELYSNMIGRPINWQDYDTTLQQIHNSGYAGYPGELKQVGVSQWDRIDGIREIFDWTGDGSRDYTLQWGHANKNGYSDRSQTVNNPAIGISAYESNNANFYNMSTITYKQNNEVSWFYGPFTTQSDSKDGSRIDSKAPAGHKLSRVKVQEKRSDLNTISSFVAAYVPEEVHPQNILEAKAITGVPAEKYLAHAGFEDKIEYMNGSNAMVSSKNGDTIDYNVQSPGKQKYKIRLRVATNSDTSVGISINGDSQQVNIKNTEAATKLEDGITVKGVNGKYMLIDGPTVELSEGVNTIQLKNSGGAKIALDRIEFEPIGGELRKWKQEGDKWYFYDENDKKLTGWQKINERKYYLGHSGDGSGMTTEGEMATGWKTIDGVQYYFGHSGDGSGMVTEGEMATGWKTINGVKYYFGQTGDGSGMQHEGEKATGWKTIDGVKYYFNKTGDGSGMQHEGEKAIGWKTIDGVKYYFNKTGDGSGMQHEGEMALGDMTIDGVKHHFNKTGDGTGRDHEGELVW

SEQ ID NO: 206 - DNA, 3528 bp, Artificial Sequence
  nucleotide sequence encoding MBP-171.2 fusion protein
atgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggtgaaagatccgcggattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatgttggaagacgcgattaaaaataaggatacccagattactccggaattaataaaaaaacttcaggacaaaggatttgattaccttagtattgtaaagggtttaactggcggattactgaagcaaattccgtatgcaggttcaatcctctcccctttggtagttggcctttttccaggtaagggttatgtaacgaaggcgaatgtctggggagagatacaggatcgcgtttcaaatttaatagatcaaaaattagaagagtcacaagtaaataacttaattgggaaactaacgggtattcaggataatttaggaatataccaaactcgggttggtttagttaatgggataaaaccaccaattgctaattttatacaaaaggatgcaaattctgataaaaataaggagaatttaagaagcacaatagactccttggacaaggatttaggccgagtgatacctgagtttgctgttaaaggttacgaggcagcttctcttccatattatgtacaagttgccaatgtgcatcttttcttattgaaagatgcacttacacatgcagatgagtgggggcttactgatgatgaaaagagaggatatttgtcaagacttcaacaaaaaattcaagagtatagcagcgtcgtatatgattcctttaataaaggagtcgaagccgctaaaagtaagggtggaagtaccgccgacagttggaacagaaccaatgcctatgtaagaacaatgacattgtatggtttagattttgtggctttatggccggcttttgatactaaacattataatcagccagtaaaattgcagcaaacacgtgaattatattctaacatgataggaagaccaataaactggcaagactatgatacaactcttcaacaaattcataatagtgggtatgcgggttatccaggcgagctgaaacaagttggtgtttcacagtgggatcgtattgatggaatcagggaaatatttgattggactggagacggctcacgagattatacgctacaatggggccacgcaaacaaaaatgggtattcggaccgtagccagaccgtcaataacccagcaataggaatttcagcatatgaatccaataatgctaatttctataatatgtctactatcacatataaacaaaataacgaagtatcttggttctatggtccatttactactcaaagcgatagtaaagatggaagtagaatagatagcaaagctccagcgggccataaattatctcgcgtcaaagtacaagaaaaaagatcagatctaaatacaatatcatcttttgtggctgcatatgttcctgaagaagttcatccacagaatatacttgaggctaaagctattacaggggtaccagctgaaaaatatctcgcacatgcaggatttgaagataagattgaatacatgaatggttcgaatgcgatggtatcttctaaaaatggtgacacgatagattacaatgttcaaagtccaggaaaacaaaaatataaaatacgcctccgtgttgcgacaaatagtgacacatctgtgggaatctctataaatggggattctcagcaagtgaatataaaaaatacagaagccgcaacaaagttagaagacggtattacagttaaaggtgtaaatgggaagtacatgttaattgacggaccaactgttgaacttagcgaaggtgtgaatacaattcagcttaaaaatagtggtggagctaagattgcattagatcgaatagaatttgagcctataggcggtgagctacgcaagtggaaacaggaaggtgataagtggtacttttacgatgaaaatgataaaaagttaacaggttggcaaaagattaatgaaagaaaatactaccttggacattctggtgatggttctggtatgaccactgaaggggagatggcaacaggctggaaaacgattgatggagtacaatattactttggacattctggtgatggttctggtatggtcactgaaggggagatggcaacaggctggaaaacgataaatggagtaaaatattattttggacagactggtgatggctctggtatgcaacacgaaggggaaaaggcaacaggctggaaaacgattgatggagtaaaatattacttcaataaaactggtgatggctctggtatgcaacacgaaggggaaaaggcaataggctggaaaacgattgatggagtaaaatattacttcaataaaactggtgatggctctggtatgcaacacgaaggagaaatggcattaggagatatgacgattgatggagtaaaacatcactttaataaaactggtgatggaacgggtcgcgaccatgaaggagagctcgtatgg

SEQ ID NO: 207 - protein, 1176 aa, Artificial Sequence
  MBP-171.2 fusion protein
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSSNNNNNNNNNNLGIEGRMLEDAIKNKDTQITPELIKKLQDKGFDYLSIVKGLTGGLLKQIPYAGSILSPLVVGLFPGKGYVTKANVWGEIQDRVSNLIDQKLEESQVNNLIGKLTGIQDNLGIYQTRVGLVNGIKPPIANFIQKDANSDKNKENLRSTIDSLDKDLGRVIPEFAVKGYEAASLPYYVQVANVHLFLLKDALTHADEWGLTDDEKRGYLSRLQQKIQEYSSVVYDSFNKGVEAAKSKGGSTADSWNRTNAYVRTMTLYGLDFVALWPAFDTKHYNQPVKLQQTRELYSNMIGRPINWQDYDTTLQQIHNSGYAGYPGELKQVGVSQWDRIDGIREIFDWTGDGSRDYTLQWGHANKNGYSDRSQTVNNPAIGISAYESNNANFYNMSTITYKQNNEVSWFYGPFTTQSDSKDGSRIDSKAPAGHKLSRVKVQEKRSDLNTISSFVAAYVPEEVHPQNILEAKAITGVPAEKYLAHAGFEDKIEYMNGSNAMVSSKNGDTIDYNVQSPGKQKYKIRLRVATNSDTSVGISINGDSQQVNIKNTEAATKLEDGITVKGVNGKYMLIDGPTVELSEGVNTIQLKNSGGAKIALDRIEFEPIGGELRKWKQEGDKWYFYDENDKKLTGWQKINERKYYLGHSGDGSGMTTEGEMATGWKTIDGVQYYFGHSGDGSGMVTEGEMATGWKTINGVKYYFGQTGDGSGMQHEGEKATGWKTIDGVKYYFNKTGDGSGMQHEGEKAIGWKTIDGVKYYFNKTGDGSGMQHEGEMALGDMTIDGVKHHFNKTGDGTGRDHEGELVW

SEQ ID NO: 208 - protein, 4 aa, Artificial Sequence
  endoplasmic reticulum targeting peptide
KDEL

That which is claimed:

1. An isolated polypeptide with pesticidal activity, selected from the group consisting of:
   a) a polypeptide comprising the amino acid sequence of any of SEQ ID NOs:66, 67, 68, 69 and 205;
   b) a polypeptide comprising an amino acid sequence having at least 95% sequence identity to the amino acid sequence of any of SEQ ID NOs:66, 67, 68, 69 and 205; and
   c) a polypeptide that is encoded by any of SEQ ID NOs:17 18, 19, 20 and 204.

2. A composition comprising the polypeptide of claim 1.

3. The composition of claim 2, wherein said composition is selected from the group consisting of a powder, dust, pellet, granule, spray, emulsion, colloid, and solution.

4. The composition of claim 3, wherein said composition is prepared by desiccation, lyophilization, homogenization, extraction, filtration, centrifugation, sedimentation, or concentration of a culture of bacterial cells.

5. The composition of claim 3, comprising from about 1% to about 99% by weight of said polypeptide.

6. A method for controlling a lepidopteran, coleopteran, nematode, or dipteran pest population comprising contacting said population with a pesticidally-effective amount of the polypeptide of claim 1.

7. A method for killing a lepidopteran, coleopteran, nematode, or dipteran pest, comprising contacting said pest with, or feeding to said pest, a pesticidally-effective amount of the polypeptide of claim 1.

8. A method for producing a polypeptide with pesticidal activity, comprising culturing a host cell comprising a nucleic acid molecule encoding the polypeptide of claim 1 under conditions in which the nucleic acid molecule encoding the polypeptide is expressed.

9. A fusion protein, wherein said fusion protein comprises a polypeptide selected from the group consisting of:
   a) a polypeptide comprising the amino acid sequence of any of SEQ ID NOs:66, 67, 68, 69 and 205;
   b) a polypeptide comprising an amino acid sequence having at least 95% sequence identity to the amino acid sequence of any of SEQ ID NOs: 66, 67, 68, 69 and 205; and
   c) a polypeptide that is encoded by any of SEQ ID NOs: 17, 18, 19, 20 and 204.

* * * * *